United States Patent 9,976,191 (RICE WHOLE GENOME BREEDING CHIP AND APPLICATION THEREOF) - sequence listing, part 4

SEQ ID NO: 49618 - DNA, 101 bp, rice(Oryza sativa)
  misc_feature (71): n=t or g
tggccggagtgcgtcgttgtcccgctacatttcgtgcaggccgagagcctgctggagtgcagcagaatggntggcgactcggcatacggtgggaatccaag

SEQ ID NO: 49619 - DNA, 101 bp, rice(Oryza sativa)
  misc_feature (71): n=a or c
gaaatatgtagacatagggtgggatcgctgatgtagggtattattcccctaaaaaataatttaaagtgatnagcaatctaggtgaaactaatgccgtgccc

SEQ ID NO: 49620 - DNA, 101 bp, rice(Oryza sativa)
  misc_feature (71): n=t or g
gggggtgatcctgaaccacctcaagagcgacagggaggtggcggagctgtggaatgggatgacgaggtcgntgaggctgacgagggtgccggcgttggaca

SEQ ID NO: 49621 - DNA, 101 bp, rice(Oryza sativa)
  misc_feature (71): n=t or c
aggagcccatagaatcgaacacgagcagtataccatttctttggttccgtgtgtataccatacattcagangacagaaaatgcatgctttcacatatacga

SEQ ID NO: 49622 - DNA, 101 bp, rice(Oryza sativa)
  misc_feature (71): n=t or c
aaccaataattcaattatcgtttatttaggtgtggccgattgagggcatcaagaagttcgagaccctctcntacctgccaccgctcaccgtggaggacctc

SEQ ID NO: 49623 - DNA, 101 bp, rice(Oryza sativa)
  misc_feature (71): n=t or g
ctccaaggcaccgaggaccacacaggcacaccaacacaacggtactgtagtttgtttggtcgaacagtttntcaggatttgggcatacggctaattgtttt

SEQ ID NO: 49624 - DNA, 101 bp, rice(Oryza sativa)
  misc_feature (71): n=a or g
ctcaagcaattcataatcatcatcgtcgacattagtcacttccttctcagatatcggcccaatcatgatcntctagttgctattaccgtctaattttattt

SEQ ID NO: 49625 - DNA, 101 bp, rice(Oryza sativa)
  misc_feature (71): n=a or c
ctggccacttccccagtccccactgctgctgacctccgactgatcctgcacaagcttcactctgtatgtgngcttctgcggatggcgatggaagggaacta

SEQ ID NO: 49626 - DNA, 101 bp, rice(Oryza sativa)
  misc_feature (71): n=t or c
acctcgtgcagtttatacattaacatgttaatcccactttactacgacgcatatatcagtggcacaactgnaattaaaccgcacaaagttagaaaaacctc

SEQ ID NO: 49627 - DNA, 101 bp, rice(Oryza sativa)
  misc_feature (71): n=a or g
ggcaggcagtcgaattggtcgaactccggagccgggtctgcgtggattcgagccctgggatgcattgtccnactcaaaggtgagcacctctttattcccac

SEQ ID NO: 49628 - DNA, 101 bp, rice(Oryza sativa)
  misc_feature (71): n=t or g
atcaataggggatcggatcgaagggggttagggttaccggttatcttgcgctgatgaagggaatggtggtngtggcgttgcataatgaggagcagcgccgc

SEQ ID NO: 49629 - DNA, 101 bp, rice(Oryza sativa)
  misc_feature (71): n=a or c
cttggtcgagacgccagtgaagatgtggttggagtagctcccactcttgatgtagcatacgcccttgtgtntctcctccaacgtccagcgttctccaacat

SEQ ID NO: 49630 - DNA, 101 bp, rice(Oryza sativa)
  misc_feature (71): n=t or c
atagctcgtctgatataggtccttcaagggatgacaacttgttgaaacgctcagagacgatcaaatcatcnggagggagcaatggtgaccattcttcctcc

SEQ ID NO: 49631 - DNA, 101 bp, rice(Oryza sativa)
  misc_feature (71): n=t or g
tttcacattgtaattgtaagtttgttcttggaagattcgttgctaatcaacaagcatgttgcataagcatnatatcaacataccttattaatgagaggttt

SEQ ID NO: 49632 - DNA, 101 bp, rice(Oryza sativa)
  misc_feature (71): n=a or c
catcgttaattttcagaaaggaattcgtgacgaaaatctcatcggcaagttcacccgcaagccgccacttnccgtcatgaagctcttcaaaacagccaatt

SEQ ID NO: 49633 - DNA, 101 bp, rice(Oryza sativa)
  misc_feature (71): n=a or g
tgttcagcatatgattagtaaaaatgacatcaaactcacaaagttctaaaaagcacatagatggcttggcncatagcactggataatcattaccaagtatt

SEQ ID NO: 49634 - DNA, 101 bp, rice(Oryza sativa)
  misc_feature (71): n=t or g
tgatgtcaggcgaagtcgatggcacatcaccgatgtttccttcatctccacttggagctttaatcttctgnttccattctgccaaggtctcatcagaagac

SEQ ID NO: 49635 - DNA, 101 bp, rice(Oryza sativa)
  misc_feature (71): n=t or g
ccttcggtcggacctgccgaaatcaagaacttaggcaacaagctcagatcagaggaaagcggcgaaggtcnagaaggaaaccatatgggcgaaggtcacaa

SEQ ID NO: 49636 - DNA, 101 bp, rice(Oryza sativa)
  misc_feature (71): n=a or c
ttggtcattggttttggttaactggacaaccgaaataccctccaagcgaagaaaacctaatttcctacccnttcccttttcaacaaaccccacggcgcttc

SEQ ID NO: 49637 - DNA, 101 bp, rice(Oryza sativa)
  misc_feature (71): n=a or g
gtgtataacctgaacttgtttttttttttgtttttggtgtcaagtttattcaaaccggcattgatgagggncacccctcttacgtggtagtagggctgtca

SEQ ID NO: 49638 - DNA, 101 bp, rice(Oryza sativa)
  misc_feature (71): n=t or c
aatctgttaaacttatctttttgcaagaattttgtaaatttgatgtgttccaacatataaactgggaggcngttccatgtgcaacgtggcgtccccgggag

SEQ ID NO: 49639 - DNA, 101 bp, rice(Oryza sativa)
  misc_feature (71): n=t or c
acattctctatacaactggaaatggctggaatttctttccccccgtcattgcaaaagatgaagttaaatancaatgcatcaaatgatccaattattaggca

SEQ ID NO: 49640 - DNA, 101 bp, rice(Oryza sativa)
  misc_feature (71): n=t or c
ggttagccattgccactgccgctgtcgttgttgtagtgattgatgatggtgatgacaaattgacaatgttnaatgtatacagagtggtttcatctgtagat

SEQ ID NO: 49641 - DNA, 101 bp, rice(Oryza sativa)
  misc_feature (71): n=t or c
gaggatgcttgctccaagataaaggaccttggactgaccaggaaatttctcaagcttctaaggtgaggtanggtgcttctttttatagttctttgaatttt

SEQ ID NO: 49642 - DNA, 101 bp, rice(Oryza sativa)
  misc_feature (71): n=a or g
ttactccattttcccccgctcagattaagatttccttggagatgaaggcttcaatgtatagctcgtgcctnccctcaagcatcggtgatctttgccctagt

SEQ ID NO: 49643 - DNA, 101 bp, rice(Oryza sativa)
  misc_feature (71): n=a or g
atctccaacagcgatagccgttcaatcaccctacattgctcaagtgcagttgttaagagagaggctagaanaatatccagggctttctggggttgaggttt

SEQ ID NO: 49644 - DNA, 101 bp, rice(Oryza sativa)
  misc_feature (71): n=t or c
ctcagtgtgagatctggtgattcagccaactggatgctggcatgctgcacaaggtctttctcttgaaatgnaggtcaactgtatgcctatatattcagtac

SEQ ID NO: 49645 - DNA, 101 bp, rice(Oryza sativa)
  misc_feature (71): n=t or c
ataatcaaggggaaatgcattgttgtgtgctctgtaattttcaccccctctgaatacaatggatggcgtgnaattcatcaactttggcactttgccctgta

SEQ ID NO: 49646 - DNA, 101 bp, rice(Oryza sativa)
  misc_feature (71): n=t or c
acgaaacctggtgagaaatctctctgaaagtccaaagtcttcacctaccaacaacactgattcagctgcangactcgacttgcagtgcaacgtaagatatc

SEQ ID NO: 49647 - DNA, 101 bp, rice(Oryza sativa)
  misc_feature (71): n=a or c
aagaaaacattgaagggtccagacgcattcctttgtataattttcgaggaaaaggttgccacattgatggntggattggatacttaagctagcagccgttc

SEQ ID NO: 49648 - DNA, 101 bp, rice(Oryza sativa)
  misc_feature (71): n=t or c
atctgactaccaaactaacgatctaacatccattttccaatcatcgatagcactaaaactaacacataganagatgcaggggtgaagcctaagcggaggtg

SEQ ID NO: 49649 - DNA, 101 bp, rice(Oryza sativa)
  misc_feature (71): n=t or g
tctttagacccaaatattctgttgaagaatagttctcttgagttttgggcacttaggggcttcatattgtnaatgcttccatggtcactggaacatgtcct

SEQ ID NO: 49650 - DNA, 101 bp, rice(Oryza sativa)
  misc_feature (71): n=a or g
tcccaccctcaatttccaaacctagtgcaaataagatctcaaggtggtctgaacgacagtttcgattgacntggcgtctacgtagcattgatatgacactt

SEQ ID NO: 49651 - DNA, 101 bp, rice(Oryza sativa)
  misc_feature (71): n=a or c
gttcgcatcagcacaatcctattttcaaccggcgagagcaatcgatacctagagccccctgagccaaaatntgcaaatggcaccttggccaatacatctca

SEQ ID NO: 49652 - DNA, 101 bp, rice(Oryza sativa)
  misc_feature (71): n=a or g
taaaactagggtaaagtagaaaacatggctgaaaagtaaatgaatattgaaaaagcgattcgagttgattntgtgttgtttttttttacaattgaacaggc

SEQ ID NO: 49653 - DNA, 101 bp, rice(Oryza sativa)
  misc_feature (71): n=a or c
acgggccctcgcaccgtcagcgtcacggacatcgcaagcgtagcagacaatagcatgatccggaaggcttntcgttccgtcgtcggcatttcctccaggat

SEQ ID NO: 49654 - DNA, 101 bp, rice(Oryza sativa)
  misc_feature (71): n=t or c
gcataagcacgcaaacagttgtatattactttgtcatcacgatgttctagaccatccacaaagcaacgctncaagctaccatcaagtagttttgtagcacc

SEQ ID NO: 49655 - DNA, 101 bp, rice(Oryza sativa)
  misc_feature (71): n=a or g
gcaaatagcactttgtggatcagaggctcaaaagcagaagtacttaccatcattaacgcagtttagaacanttggttgctgggtgagttgcattctcctat

SEQ ID NO: 49656 - DNA, 101 bp, rice(Oryza sativa)
  misc_feature (71): n=a or g
tttcatacggtgttattttcatttccttttgtgttgcaatttgcatagcaaaacaagcatcaacgtcgtcnttatcgtattccacccgtcaataataagct

SEQ ID NO: 49657 - DNA, 101 bp, rice(Oryza sativa)
  misc_feature (71): n=t or c
ccggcgcggcgctcttggtcaaacagagctttgctacccgctgcgtggcttacacagttcggttgattgcngcggtgcaggcaggacggagacggtgaaga

SEQ ID NO: 49658 - DNA, 101 bp, rice(Oryza sativa)
  misc_feature (71): n=a or c
tgcagtgacttgagctggacagcaaagacaccaactgccgtccatataaaaaacaaatcatcttcctccanaagacctaatatcctgactggaggccttct

SEQ ID NO: 49659 - DNA, 101 bp, rice(Oryza sativa)
  misc_feature (71): n=a or g
gataaattacataattgcatacccagattgagaattgtaacataatgcatgcccagattgagaattgtacnatatttgtgctcgatcaacatggaaactca

SEQ ID NO: 49660 - DNA, 101 bp, rice(Oryza sativa)
  misc_feature (71): n=t or c
atatggcctccgcatatgtactgtgtaaaataaaaaactgaatgcactactcctgcaccgatagcgtgtanagcattaatcccactctaaattagagtagt

SEQ ID NO: 49661 - DNA, 101 bp, rice(Oryza sativa)
  misc_feature (71): n=a or g
tgttccttgccatccttggccccagcaagaatgctagagtgctagacattcccaacttccaaaatgagcanccaactactacatacgaactaagctggtgg

SEQ ID NO: 49662 - DNA, 101 bp, rice(Oryza sativa)
  misc_feature (71): n=a or g
taataaaacaacactatacaaatacgaacacatctaaaaaagcttttggagaaccgcacaataatcttccngctagctccacaaaatgatgggctagacaa

SEQ ID NO: 49663 - DNA, 101 bp, rice(Oryza sativa)
  misc_feature (71): n=t or c
aagggggacaactgttgtgtttggaaaatccaaagtccaaggagctgatgtaaagacccaatccaaccttncaaggaggggattatgctgcatgttgctcc

SEQ ID NO: 49664 - DNA, 101 bp, rice(Oryza sativa)
  misc_feature (71): n=t or c
actgtttgaagggagttaggatgcatgtcagttaggttcgtgtctgggtggtcgagggtgttttcttaaangtcctggaaaggtaatgaggattagacatc

SEQ ID NO: 49665 - DNA, 101 bp, rice(Oryza sativa)
  misc_feature (71): n=a or c
gtgtggacctcatttttataatcctaactttttttttccactttgcaggatgatggcatgccaactgattncctgaaggaactggtggagcaaatcgtttc

SEQ ID NO: 49666 - DNA, 101 bp, rice(Oryza sativa)
  misc_feature (71): n=a or c
tgaagagttgtataaggtgttgagagaggctaaaccaaacactgcctttggtccagatggatttagtattnctttttatagagctttttggccacaactaa

SEQ ID NO: 49667 - DNA, 101 bp, rice(Oryza sativa)
  misc_feature (71): n=t or g
aattactatatttttagatgaaaatagtagtttattttagctccgccactacgaatattgtgatttctttnatctaaatcttcttaatttcaacaccaata

SEQ ID NO: 49668 - DNA, 101 bp, rice(Oryza sativa)
  misc_feature (71): n=a or g
tcctatgcggtaaatcggttttttgcgtgcagagatttggcctgtctggaacaaatcgcctgggaaaatcncgaaatctgcggttgcttatgccaccgcac

SEQ ID NO: 49669 - DNA, 101 bp, rice(Oryza sativa)
  misc_feature (71): n=t or g
ttgatatagttctttatttaactgaacttgtgctaaagggcattacatggttttttagcgaatagaagcanaatttatctgatgcttcatatgtattaaaa

SEQ ID NO: 49670 - DNA, 101 bp, rice(Oryza sativa)
  misc_feature (71): n=t or g
ctctggcgatgttcttccgtgcaatttgtaaaggaagaatccggagcttcaagagttgggtaaagaaatanagactaacatttcattcggtaaaaattcta

SEQ ID NO: 49671 - DNA, 101 bp, rice(Oryza sativa)
  misc_feature (71): n=t or c
caaagcttctattctccaagtcagcctgcttttcccgaaatctttcaagttctgatctgcagagacaccanaacatgaatcacaaagttataatcatccca

SEQ ID NO: 49672 - DNA, 101 bp, rice(Oryza sativa)
  misc_feature (71): n=a or c
tatgaacattgctatagttatttgatattcaggaggcttgttaactcctgaatatgcgcactatggcattnagaagtagcagtagcagcagtagtatggtt

SEQ ID NO: 49673 - DNA, 101 bp, rice(Oryza sativa)
  misc_feature (71): n=a or c
aacgcaagaatcgtcgccacagtcaccaaggacactattgtcacatctgtctgcataatcgtcatcaaatntaacaattgcagctaccaaggatggcatgc

SEQ ID NO: 49674 - DNA, 101 bp, rice(Oryza sativa)
  misc_feature (71): n=t or g
tgatgaaggggacccatatctgtcatagcgaactcacgctgaagagcagcgatcacctgctgcagaagacnggcagatgaagcagtgagaacgatatcgtc

SEQ ID NO: 49675 - DNA, 101 bp, rice(Oryza sativa)
  misc_feature (71): n=a or c
ggacggtgcggctactctggtcagcggtgaccaccatgttgtggttgccgccgaggagcacgaacctcatncgctccgtgccgccaaaccacctggagagg

SEQ ID NO: 49676 - DNA, 101 bp, rice(Oryza sativa)
  misc_feature (71): n=a or g
gcttcgagacaaaaaaaaaacccctcattacttccctcggagtagctgagatgattatgtgttatttactnatggtatgaacaatgaattaattaaagctt

SEQ ID NO: 49677 - DNA, 101 bp, rice(Oryza sativa)
  misc_feature (71): n=t or c
aattcaagaagaaaccaaaatgatcttttgtttgcatcttgctgtggctgttttcccaaattttggacgcnttcggtatcatgttataatatgttttaatt

SEQ ID NO: 49678 - DNA, 101 bp, rice(Oryza sativa)
  misc_feature (71): n=t or c
atcagagtcggagacataatactccaccacccatggagaagctaaagaactagagtcccaagaatgttgangtgggatagaaagaagtggtccaccggagt

SEQ ID NO: 49679 - DNA, 101 bp, rice(Oryza sativa)
  misc_feature (71): n=t or g
agaacacaataggcaagcgatggtgatgctatcacagtggtggtgccgagatgacagttagcaaggagtgntgatgctgcgatgctaggcaacatgggtat

SEQ ID NO: 49680 - DNA, 101 bp, rice(Oryza sativa)
  misc_feature (71): n=t or c
aaatctcgaacaaatggcaccggatcttcgcccccacacatcagcgatcgaaatctagagaagcgagaaanggcggatccagtagaatcatcgggtgacgg

SEQ ID NO: 49681 - DNA, 101 bp, rice(Oryza sativa)
  misc_feature (71): n=a or g
ttggcagatgcatggcacaagtacaacaacaccaccaatgaaatgaatgaatgtaccgtttagaccctaanctaatctagtcaagtgttatgagatttggt

SEQ ID NO: 49682 - DNA, 101 bp, rice(Oryza sativa)
  misc_feature (71): n=t or g
aacagagtttgtggcacaaagaccacacatccatcttgattcagtgggagaggaggtggaaaggaattgcnctggtggcacagagagcaaaataacaaggt

SEQ ID NO: 49683 - DNA, 101 bp, rice(Oryza sativa)
  misc_feature (71): n=t or c
tcggtcttacacttccctgtgcggctctgcccagtgccccctgcttgtctggcagcaacgaggcgtaaacnagatgaaacccgctcattgctacgggaatt

SEQ ID NO: 49684 - DNA, 101 bp, rice(Oryza sativa)
  misc_feature (71): n=a or g
gcggcattacatgacgctacacgagctcgggttctcctcgttgaacatgttgctgtaagactcctgcggcngcgacgaccgcatgcccggcgggccgtaca

SEQ ID NO: 49685 - DNA, 101 bp, rice(Oryza sativa)
  misc_feature (71): n=t or c
cagaagagaaatgcgactggtatccttggactgtcatgtttacaaaaggtaacaacagtatcacgcatgtnatgttatggaatagcaacagatgcaattga

SEQ ID NO: 49686 - DNA, 101 bp, rice(Oryza sativa)
  misc_feature (71): n=t or c
tcacgtcaaatatcacctagtcattttgtgtcggtttcaatagttagaggaatcattataccttgttttangattgaattgaaggatacgaataagatcca

SEQ ID NO: 49687 - DNA, 101 bp, rice(Oryza sativa)
  misc_feature (71): n=t or g
atccaagtccaagcgtccaacccaccttgccgagacgcctaaaatataaaatataaagggaaatgctacgngacactatctcgtttgggcgtgatgatatc

SEQ ID NO: 49688 - DNA, 101 bp, rice(Oryza sativa)
  misc_feature (71): n=t or g
tactatgactgtaattcatactgtttcaacatttggatgcattgcatgcatgcttaatttcaacatactantatataattaagtactccctccgtttaata

SEQ ID NO: 49689 - DNA, 101 bp, rice(Oryza sativa)
  misc_feature (71): n=a or c
ttacaggtatacagaagcaataggagattgcttggtgaaacaattcaggccatggaaacttcaagagaggnctttgcaagccacagcaagccaggatcgtt

SEQ ID NO: 49690 - DNA, 101 bp, rice(Oryza sativa)
  misc_feature (71): n=a or g
agaaccacatgctctcttcctcctccctcccatggcgcccgtgcccatctccgtcttcgtcttcgtcttcntcttcattttcttcctcctcgacggctcga

SEQ ID NO: 49691 - DNA, 101 bp, rice(Oryza sativa)
  misc_feature (71): n=t or c
aaggactgctgccagcccaagaaacaagtcgcggcacacgtcgcacaaggtgaggaggaagatgatgagcnggcgctgctgatggctcacgcggttgagct

SEQ ID NO: 49692 - DNA, 101 bp, rice(Oryza sativa)
  misc_feature (71): n=t or g
gttttgaaggagaaacttatcaagtggttattctatcaatgcttttcaaagacgagaacacgattcttcanattgaaaagatcaatgctgcaattaccaaa

SEQ ID NO: 49693 - DNA, 101 bp, rice(Oryza sativa)
  misc_feature (71): n=t or c
tagtaggaagagaagaaggagaggagtagtgtatagggggctgggggtgatagctgtggctgatcacctgnccattagccatgcccacttgtatgtgcgtg

SEQ ID NO: 49694 - DNA, 101 bp, rice(Oryza sativa)
  misc_feature (71): n=a or g
ggggcagagttattatatttgtagaagaaatcatagtgctattataatgagaggtaagtgggtgagaatgngaggtatgcaggaaacaagggagaagcact

SEQ ID NO: 49695 - DNA, 101 bp, rice(Oryza sativa)
  misc_feature (71): n=t or g
taggtttttcttgagcatgcaagaggggaggcaaaggattttgtgtaatgatgctcttcaaggaaagtatncataattatgattataatgtaatatgtgga

SEQ ID NO: 49696 - DNA, 101 bp, rice(Oryza sativa)
  misc_feature (71): n=t or g
ctgtcgtcggtcgcatgtgtgtggcgtggtactcctattcactgttgtggcttgaacctttagtattgcanattgattctcaatttatgttgagtaaattt

SEQ ID NO: 49697 - DNA, 101 bp, rice(Oryza sativa)
  misc_feature (71): n=t or c
tataagatgatcagaccgatgacaacgacgactgcagatgaacggaacagcagccaaatcaatcgttctanctataactaactgtaaaccataacgcttat

SEQ ID NO: 49698 - DNA, 101 bp, rice(Oryza sativa)
  misc_feature (71): n=t or c
ggtcctgtcttccaatacaacctcttgcacaaacttgatggaatcctgcaatcacatcaagaaaagtatanccattattatttgggagaaggaagatttaa

SEQ ID NO: 49699 - DNA, 101 bp, rice(Oryza sativa)
  misc_feature (71): n=t or g
gtcctctctaatgactaccacagaatctattattgttgagatccccaaggaagaggaggcagcagccgcancacccgcaatgggtggcatgggcgggatgg

SEQ ID NO: 49700 - DNA, 101 bp, rice(Oryza sativa)
  misc_feature (71): n=t or g
ctgaaattccctgatggatatgcagccaatattagccgtggggtgaatttggcacagaaaaagatttttgncatgaaaagccatgattatcacatatttat

SEQ ID NO: 49701 - DNA, 101 bp, rice(Oryza sativa)
  misc_feature (71): n=t or c
attgaccctgtgccacaaagttgattggtattgaaaaatcgccccatagttgaggcgattgccctctcttntgccacaacaccatgtacgttccctttcaa

SEQ ID NO: 49702 - DNA, 101 bp, rice(Oryza sativa)
  misc_feature (71): n=t or c
acaaactctataaaaatatgaatttcagttttaccttttctagcttggccagtgtttcaagcggtttaccnttaggggttgtattttctcctactctattc

SEQ ID NO: 49703 - DNA, 101 bp, rice(Oryza sativa)
  misc_feature (71): n=a or g
atgcggaacaaggcttgctctaagcttcactggagtaatactgaggccgtcattatcatgtggcaaactcnccaacagcttgccatcagtaccaatgtaga

SEQ ID NO: 49704 - DNA, 101 bp, rice(Oryza sativa)
  misc_feature (71): n=t or c
caacctagtcgaggatcattgcaacggactccttctgctaaagtccggcgtggctaaccctgctacccganagtgggtgccttctcctcctgccccacctc

SEQ ID NO: 49705 - DNA, 101 bp, rice(Oryza sativa)
  misc_feature (71): n=t or c
aatagtgataacagctgtacacccatgaatctactactcgcatgctttcgtaagaagtttttttccccctnaaatgtgctgagacagaattttgaattaaa

SEQ ID NO: 49706 - DNA, 101 bp, rice(Oryza sativa)
  misc_feature (71): n=a or g
aggcatgcgcagccgatgaaggcgtgaggccggagtagatgtgcatttgggtgaggatgtgctcgaagttntcgttggatttctcgatggggtgcgtgtgc

SEQ ID NO: 49707 - DNA, 101 bp, rice(Oryza sativa)
  misc_feature (71): n=t or c
tcgagggagcaaagtgataatcataagtcggattggaaagcttgcaaggtttggaacagtaaagacagttngtctaaacagtttatcacaagaggaatata

SEQ ID NO: 49708 - DNA, 101 bp, rice(Oryza sativa)
  misc_feature (71): n=t or c
ttcatggttggatatgatcgcgcatggtcccaccaacgaacatggtcaagaaagacaaaggggtggtcgancacaatgacggcggtgaggcggagtcagag

SEQ ID NO: 49709 - DNA, 101 bp, rice(Oryza sativa)
  misc_feature (71): n=a or g
tcctgagtatttttttgtaaagaaataaatttggaacttttattcatgtagcattttcaaagcacaatgtnccatacagagtacattaacattcaaccaac

SEQ ID NO: 49710 - DNA, 101 bp, rice(Oryza sativa)
  misc_feature (71): n=t or c
tcttagtgtttttggatattcttagattggtcgtatttttttaattcgtgaaacctcaaatatgtcggttnctaaatcggcacctatttcccctccacatc

SEQ ID NO: 49711 - DNA, 101 bp, rice(Oryza sativa)
  misc_feature (71): n=a or g
aggatatctctacggtgccatatcagaatgccccatcatcactgggaatgctagagccatggccaaagtcngagttgtcaataatgccaaaaccatgaccg

SEQ ID NO: 49712 - DNA, 101 bp, rice(Oryza sativa)
  misc_feature (71): n=a or g
aaaattccattttgtagtagtgttatagcactcaatgacggtggtttaagtcgataactttggggaaaccntcataaccgccattcgggagtcatcaagag

SEQ ID NO: 49713 - DNA, 101 bp, rice(Oryza sativa)
  misc_feature (71): n=t or g
attaatatcaaatcacacacactacgtacgtacgacaagtcatggtgtgtgaaattcaacgaacatatcangggatcggacacactaatagatggtcctcc

SEQ ID NO: 49714 - DNA, 101 bp, rice(Oryza sativa)
  misc_feature (71): n=t or g
cagctgcggtggcgaggaggaggaacatcagcagcagcggcagagcggttgagactgaagactttcttgtntgcgctgcgtgctttagctccatgatcaat

SEQ ID NO: 49715 - DNA, 101 bp, rice(Oryza sativa)
  misc_feature (71): n=t or c
gcacctcgagttccttcacaaagggttctctcgttctcggagaacatccacggagatcgacggtcttgtgnagtcgatggcgccgcttgccgagaaggttt

SEQ ID NO: 49716 - DNA, 101 bp, rice(Oryza sativa)
  misc_feature (71): n=t or c
actactatctattgttgatggtaaaacctgaaaaagacggagtagaactgggaggtaccttctaccatgcntttcactcttttttgacttataactggttg

SEQ ID NO: 49717 - DNA, 101 bp, rice(Oryza sativa)
  misc_feature (71): n=a or c
tttttttctaatttcccataggcttacccaattgttagcattggtgctagccactaaataagaaaatgttnagtacacccatattttcactgaaagacact

SEQ ID NO: 49718 - DNA, 101 bp, rice(Oryza sativa)
  misc_feature (71): n=a or g
caaatgtactggatggccttgatcaaaaagctcatgcggatgggtaccatacatggacaaatacttcttgnctgtaatttggacccctttcaatgcaaaaa

SEQ ID NO: 49719 - DNA, 101 bp, rice(Oryza sativa)
  misc_feature (71): n=a or g
attgggagaatgcgtattatggctggtaggtggattcaaaattttgaaatttgcctttctgcagggggggnaaccgcagcagcagcggggagagtttggtc

SEQ ID NO: 49720 - DNA, 101 bp, rice(Oryza sativa)
  misc_feature (71): n=t or c
ttgagctcctctttgattgctttacatcatctgaggcatctcgatctgagttgcaatttcttcaacggaangagcatacctgttttcatgggctctttcaa

SEQ ID NO: 49721 - DNA, 101 bp, rice(Oryza sativa)
  misc_feature (71): n=a or g
cgaagggcgccgtgacggtggaagtgaggatgggtcgccggtcgagattgatgcaaatcaagctggaatcnaggttgatcgacggcttgggaaggagctcg

SEQ ID NO: 49722 - DNA, 101 bp, rice(Oryza sativa)
  misc_feature (71): n=a or g
ggagtgaggttgctgccaccccatgattttggtatatcgtggttctagaaactgaaaatattatcgcatgntatatcattattttaaaaactgaaaaagtt

SEQ ID NO: 49723 - DNA, 101 bp, rice(Oryza sativa)
  misc_feature (71): n=a or g
agatgatagtgatgcatccagcagtgaagatgaagctcaaaaccctcaaattattcttagtaaagaggatntttacaaggttatttgaatttttaccatta

SEQ ID NO: 49724 - DNA, 101 bp, rice(Oryza sativa)
  misc_feature (71): n=t or c
tggcatatgaggaaatgaagaaaatcatttagtggcatgtacagaggaatagcaaattttcaagggcatangaggaaaccggtgagcattcaatggtatat

SEQ ID NO: 49725 - DNA, 101 bp, rice(Oryza sativa)
  misc_feature (71): n=a or g
gttcggggcgtgacaatatgttagggtgtgacagttagttatggaactgctgtgagaaagtgagctacccntggaatcataagcacgataaatcttgaatt

SEQ ID NO: 49726 - DNA, 101 bp, rice(Oryza sativa)
  misc_feature (71): n=t or c
cctgaattgtttgtagaggacatatgcagctcccaagacctgcacaacgacagtgagaaggtgtcggagcnagagcttactgtcctcgagggaatatgcgg

SEQ ID NO: 49727 - DNA, 101 bp, rice(Oryza sativa)
  misc_feature (71): n=t or c
ataaaatgataaaaaccattcttcgaaaaagagagaaaagttgctgtaaccctatcgatcatgatattagnttaagtcaataatccaatcatgctaagctg

SEQ ID NO: 49728 - DNA, 101 bp, rice(Oryza sativa)
  misc_feature (71): n=t or g
ggatcttgattctctgggacatcatttttcttcatcatccctttctctgtttcttctgccttcaccacctnctccacattttcagctttgccttccttgcc

SEQ ID NO: 49729 - DNA, 101 bp, rice(Oryza sativa)
  misc_feature (71): n=t or g
ctaaaattgctgatttattattttccctcgcaggagtaactgatagaaaatgactatcattgttctagcanatgtggatgggagtatccaaaatggaatta

SEQ ID NO: 49730 - DNA, 101 bp, rice(Oryza sativa)
  misc_feature (71): n=a or g
gctccagaatatctgctgcattaaattgtggaaataatactgcaacagattatgttgaggccctgacaacnttacatgtcttttccgattgtagccaaaat

SEQ ID NO: 49731 - DNA, 101 bp, rice(Oryza sativa)
  misc_feature (71): n=a or c
aagtttcaacacatcaaacaaagaggctaatgcagtaattcatccaaacaaaatacctgtagacccaatgncttcatgtgatgttcatcatgaagctccct

SEQ ID NO: 49732 - DNA, 101 bp, rice(Oryza sativa)
  misc_feature (71): n=a or g
tgcattggaggtatgccaccaaagtgaaatccagcgaacagtttctgcatttgctcgactacagaaatacncagaatcaagaaaagagatagacagaaggc

SEQ ID NO: 49733 - DNA, 101 bp, rice(Oryza sativa)
  misc_feature (71): n=a or g
tgctcatagattgctccaggcactgatcgatgtcatctccagcaacggatggctcaccctcgctctcaacncaatggagctgagccagatggtgacacagg

SEQ ID NO: 49734 - DNA, 101 bp, rice(Oryza sativa)
  misc_feature (71): n=a or g
gggagggttgcaattaatatcaatggagaggtgaaagattttttcaaaacctatagaggagtcagacaggnggatcccctttcccctttattgttcaattt

SEQ ID NO: 49735 - DNA, 101 bp, rice(Oryza sativa)
  misc_feature (71): n=t or c
ctccaaaatgagctgccttctgcgcttgggaattatcactagggatgccaatgttgaattggacatggaancatttaatcctacaccgtctaagctacaga

SEQ ID NO: 49736 - DNA, 101 bp, rice(Oryza sativa)
  misc_feature (71): n=a or g
tggcattttgaaaaggtactaataaatagagaattgggaaagtatattttaggcgtgagtagaggtgatcnacatagttatatagagagcacatcgaaaat

SEQ ID NO: 49737 - DNA, 101 bp, rice(Oryza sativa)
  misc_feature (71): n=t or c
tagctagtgtgagtcactgaagtgcgctaggatgtcaaattatatgctactctcaaatttaatgccccaanaaattcagcatctcacttacactccaagga

SEQ ID NO: 49738 - DNA, 101 bp, rice(Oryza sativa)
  misc_feature (71): n=a or g
cattcattaatatctgcaacatcacttagtaagatcagagaaagagcgagatcggaagggagagggagaanggcagagattataaccttggcaaccatctt

SEQ ID NO: 49739 - DNA, 101 bp, rice(Oryza sativa)
  misc_feature (71): n=t or c
attgacacctatatattaactaggccattttggtaggtttaggcacacctatttttaggtttggaatccgnaatgccagttcatctgaattgctcttgtgt

SEQ ID NO: 49740 - DNA, 101 bp, rice(Oryza sativa)
  misc_feature (71): n=t or g
tgatggagtaggatggaaatggaattgagctgtgagctgttaccacaggcaagagatttggggtttctatngctggactagtaaaaacgtgaatattagag

SEQ ID NO: 49741 - DNA, 101 bp, rice(Oryza sativa)
  misc_feature (71): n=t or g
cagtcagcaaagacttcacggcagctcttttcagatttttctggccttataatgcccactactgcatattnatttatccagagttccagactatactcaat

SEQ ID NO: 49742 - DNA, 101 bp, rice(Oryza sativa)
  misc_feature (71): n=a or g
agtatatctttagctaattaagctatagctatatagctcgcagttggtcgcacgtcagcaaaactagcgtngctatagctaaggctcggttgctgcacgga

SEQ ID NO: 49743 - DNA, 101 bp, rice(Oryza sativa)
  misc_feature (71): n=t or g
cattcagctaatgccagtgtgcttcttccagctgtttacaagactacaactggagtggtttagagatgatncacctaaatataaagataagatcttgaagg

SEQ ID NO: 49744 - DNA, 101 bp, rice(Oryza sativa)
  misc_feature (71): n=t or c
gcaattttttttaccgttgcaatacccaactagagttagacgttggctcctacttcctacgttgtctctcnaaccaaataaagtaggtaattctgtgagca

SEQ ID NO: 49745 - DNA, 101 bp, rice(Oryza sativa)
  misc_feature (71): n=t or c
ccatatatacccgaccaccaccgggcaacggttgatcgatatagccagtgaggagaagggttatagaggcngatcgaccatcgatcgacgtcgtggcgagc

SEQ ID NO: 49746 - DNA, 101 bp, rice(Oryza sativa)
  misc_feature (71): n=a or g
aagaaaaaaatgaaaagcattgtctaaagcatggctgcttgcattcattgcatatagcgaggtttagactncatacacatgtgtccaaaaaaaaacgatta

SEQ ID NO: 49747 - DNA, 101 bp, rice(Oryza sativa)
  misc_feature (71): n=a or c
tggggcgtttgttttttttttccggggaaaaagggaaatttcattaatcaatcaaagaatcctcacacacnaggtgtgttatgaggttacaagtgttgtct

SEQ ID NO: 49748 - DNA, 101 bp, rice(Oryza sativa)
  misc_feature (71): n=t or c
tccatgggagtgtgcacaaacacaaaacacaaacattttagtgatatattgcttgcgtcctcgagatgatngttacttgccagatacattttagtgatata

SEQ ID NO: 49749 - DNA, 101 bp, rice(Oryza sativa)
  misc_feature (71): n=t or c
cactacatttagaatagttcgttcataactttatattgatagtgcggcatgatgcaaaatagcgtattacncctatctatcagtgcatctttacataatat

SEQ ID NO: 49750 - DNA, 101 bp, rice(Oryza sativa)
  misc_feature (71): n=a or c
ctagaaacccactcaggagctatataacctctagttccatggatacgtgatacatttttattggatccccntctgttcaggagttttgcaaggccaaagtc

SEQ ID NO: 49751 - DNA, 101 bp, rice(Oryza sativa)
  misc_feature (71): n=a or g
gttgacgctgcggttttgcgtgtggttttggtctattgcgcattattgtcgattgggttatgtggttgacnaaaatatggagaatttttttttgccgcata

SEQ ID NO: 49752 - DNA, 101 bp, rice(Oryza sativa)
  misc_feature (71): n=t or c
gcaacacttcgtttcatgtcttcttaaaaatttaatagcacttgccaaatgaacagccccgtcattacgcntatacttacgtttatccatatcacttatta

SEQ ID NO: 49753 - DNA, 101 bp, rice(Oryza sativa)
  misc_feature (71): n=t or g
catcgccaccagcgccggaattcctatggagaaataataataaaaaaaggctaagtactctctttgtattnttatgaccatgtttttgtgtagataaaaaa

SEQ ID NO: 49754 - DNA, 101 bp, rice(Oryza sativa)
  misc_feature (71): n=t or g
tcgtactttttccaaaagaaaatgaaaataacagattacacctggtacaatggaaaacaaacatattatcnctgtcgcccattatcatggttcttctaggt

SEQ ID NO: 49755 - DNA, 101 bp, rice(Oryza sativa)
  misc_feature (71): n=t or g
cgacatcattcttgaatggataattagagatgcgaggccaaactaaacgacattaactcgttcacgtaccngcgcaagtattcgtagttggttttggtaca

SEQ ID NO: 49756 - DNA, 101 bp, rice(Oryza sativa)
  misc_feature (71): n=t or c
cctttcacatcatcacatctttctatccctccacttttggtctccaagtgaaaaccttgattcgatttacnggactagtggcgacagcatctcatgacagt

SEQ ID NO: 49757 - DNA, 101 bp, rice(Oryza sativa)
  misc_feature (71): n=t or c
actatgactttgagtggtactaagcgcaaaatggaccaaactgaagaggcagagggcaagcaggcaaaganctccaagtagcatcaatttatcaagtatct

SEQ ID NO: 49758 - DNA, 101 bp, rice(Oryza sativa)
  misc_feature (71): n=a or g
cctgccagaggagcaaggctcttctttgggctgcgaggtgtcaatctgctgacgattgatggtaggcatanccacaggcaccttcagaattgggggctgta

SEQ ID NO: 49759 - DNA, 101 bp, rice(Oryza sativa)
  misc_feature (71): n=a or c
ccaccggtggacgccgccgcgcggttttattacctctaggcttctttgtactatcactgattcactgtacngcgtgtgtatgtgcgaaacgtggtggctag

SEQ ID NO: 49760 - DNA, 101 bp, rice(Oryza sativa)
  misc_feature (71): n=t or c
gtagtttgttctggatcttcatgctgcttgtcaccgaggtacactacatagagctgcatatataggtgcangcatgttaagtttgcaaattatatgttgtc

SEQ ID NO: 49761 - DNA, 101 bp, rice(Oryza sativa)
  misc_feature (71): n=a or g
aagagcccaagcaccataatggcctctgatttcaagacattgctgctcaaccatgccggggacctggacancatggtccggtcatcggcgaacatcatcac

SEQ ID NO: 49762 - DNA, 101 bp, rice(Oryza sativa)
  misc_feature (71): n=t or g
actcctatccactagcagtccaattaattttctctgtgatccggtgccctctgacccgcaacttccttttngcactaaactcgtcttatccgcatgattgt

SEQ ID NO: 49763 - DNA, 101 bp, rice(Oryza sativa)
  misc_feature (71): n=a or g
aatttcctccaatgctgatgagccggtggcaaaatccagtgagacagatagagatcaggagggagacaaanatcatagttctggcagtgacattagtgaag

SEQ ID NO: 49764 - DNA, 101 bp, rice(Oryza sativa)
  misc_feature (71): n=a or g
attgccggagcgaagagaggttgctgatgccggtaagcttgggcttcttcgcctgcttgaagtggagatcnagcttcagaagctgggccatggctccgtct

SEQ ID NO: 49765 - DNA, 101 bp, rice(Oryza sativa)
  misc_feature (71): n=t or c
tgaattctttatcatatcttaggtatatcttctcttacttctagttggcaagtccatccggtcgatgcctncttcattggcgacgcaagtcagaagtgccg

SEQ ID NO: 49766 - DNA, 101 bp, rice(Oryza sativa)
  misc_feature (71): n=t or c
tttacttaaattaacagtatttaagtcatgcatgctttcagcgtacttagtacccctccgtcccaaattanagggcgccaagtaaaattaaacttggtagc

SEQ ID NO: 49767 - DNA, 101 bp, rice(Oryza sativa)
  misc_feature (71): n=t or c
ctggtaaaatcgcatcaaaatagcttcttatacatatatccaaaccctagccaaccatccttcaccttctntttccccaccctcacgccgccgcccaccac

SEQ ID NO: 49768 - DNA, 101 bp, rice(Oryza sativa)
  misc_feature (71): n=t or c
tttgtaataaggttccttgtcaaatttttgcctacttaatagctgaaagtaaggaactacaacagtaagtnagtcctatgagagatcagttcattggacaa

SEQ ID NO: 49769 - DNA, 101 bp, rice(Oryza sativa)
  misc_feature (71): n=a or g
caaatcatcgaactcgaacattggcatcaacattgtctcctataatatatcgtacaatctagaaacgcttngaattggtagctaaggaactttattccagt

SEQ ID NO: 49770 - DNA, 101 bp, rice(Oryza sativa)
  misc_feature (71): n=t or c
ggctatataattcgctttgaaatttaactgtcttcaattttccttttgtaggctttagccgatctgttctngtttgacatcaaggattactttgatgaaga

SEQ ID NO: 49771 - DNA, 101 bp, rice(Oryza sativa)
  misc_feature (71): n=t or c
tatatacctggaatgcagaagcttgtgtagggaacaactgaagtgcatttgtcaaacaccttcctggaccnccttgaattgagttggaccatatagacagc

SEQ ID NO: 49772 - DNA, 101 bp, rice(Oryza sativa)
  misc_feature (71): n=t or c
cgagagagaaagggagagatatgcgagagatcgagaaagggagggagtagatgtaacgtcctgcctctccnaggccgggcccgcttacatctggcagcttt

SEQ ID NO: 49773 - DNA, 101 bp, rice(Oryza sativa)
  misc_feature (71): n=t or c
cagacatcatcaggcatctccttcggaatcacgcgttcctcgttgaggaacaccgtctggtgcacttcggngaaaagcagcgccggctgttcattctcaac

SEQ ID NO: 49774 - DNA, 101 bp, rice(Oryza sativa)
  misc_feature (71): n=a or g
catgcaaattatacttctctccatggacttcagttatacacgacgagagaagagaagatcagatgaccggntttttttacatttcgacccttttaaaaact

SEQ ID NO: 49775 - DNA, 101 bp, rice(Oryza sativa)
  misc_feature (71): n=a or c
ctacctaggatagactaggtttgtttgagcctagctcatcaacatactcactttgtcaaataaaaacaatntagtacgatatgtgacatatatagtactat

SEQ ID NO: 49776 - DNA, 101 bp, rice(Oryza sativa)
  misc_feature (71): n=t or c
cgttctccaatgacaaatgaaatggcagaaaggggaggggaaaaaaatactatttcgtgtatcaagaagcngaaactactatgaaatatacactatgcttc

SEQ ID NO: 49777 - DNA, 101 bp, rice(Oryza sativa)
  misc_feature (71): n=t or c
cgatcttggtcagtcggcccggtttctatcgtaggaccaatctccgtgctagtcagttcaaagtcttttcnagaaggatcaatgtcagatggttttctgca

SEQ ID NO: 49778 - DNA, 101 bp, rice(Oryza sativa)
  misc_feature (71): n=t or c
caatatcttccttgtgttttggactgcttcatttcgatcttcaagcccaaaaccgatagagttgtatactntggaccagtcttccactggtttattaacta

SEQ ID NO: 49779 - DNA, 101 bp, rice(Oryza sativa)
  misc_feature (71): n=t or c
atatagaacggaagggtgtacatgttgctaaatgagaccggtaagacttcgacagttacactatagctaancacgcacaccattcactacaagcatatata

SEQ ID NO: 49780 - DNA, 101 bp, rice(Oryza sativa)
  misc_feature (71): n=a or g
ggaatggaggggagaggaagggatgacaggaaatattaatgagaggggagaggagatcgagagaagagcgnataaagatggcgcgcgcggttcgagttgct

SEQ ID NO: 49781 - DNA, 101 bp, rice(Oryza sativa)
  misc_feature (71): n=t or c
acatcctttgtttgcaccttcagagactcaaggtactgaataaaattggagaacacgatgtacccatctgnggtgttaggccggacagcctgaagcagatg

SEQ ID NO: 49782 - DNA, 101 bp, rice(Oryza sativa)
  misc_feature (71): n=t or c
atttctttggagttgcctgttttctgtgcctgtattcatgttctccatggttctgccaatgatttctcctnttggggattggctgttttacaaagtatgca

SEQ ID NO: 49783 - DNA, 101 bp, rice(Oryza sativa)
  misc_feature (71): n=a or g
agactccccttcctgattaccagaacgtccagacttgaaccagaatgaaccaaatcgtttcattgtaacgngctcttcttcaccaccaaaagtaatgttag

SEQ ID NO: 49784 - DNA, 101 bp, rice(Oryza sativa)
  misc_feature (71): n=t or c
ttaaaccgaccatttttcagatttaaagaaggccatgcgttactttgtcccacattttcctatatccttangttatgtttatgtttttattgtcatgtata

SEQ ID NO: 49785 - DNA, 101 bp, rice(Oryza sativa)
  misc_feature (71): n=a or g
gcgccgctgccgccgacgtgcgtgagggaggatgcttcgattgggttagcattagttttttactttttacntttagtaattatataaaatccaatccccat

SEQ ID NO: 49786 - DNA, 101 bp, rice(Oryza sativa)
  misc_feature (71): n=a or g
acaatgtgtgaaaaaagataaccttgttttaattgtacttgtaaagggagcgatatacactgtataaagtnacattagcttaggatgcaccctatgcttag

SEQ ID NO: 49787 - DNA, 101 bp, rice(Oryza sativa)
  misc_feature (71): n=t or c
tagcttcttttcaattctcagaaatttcgctaattttcacaagttcaggagatcgtcgtgcgtgacttgcntatcggagacctcctgtgcccatatcctgc

SEQ ID NO: 49788 - DNA, 101 bp, rice(Oryza sativa)
  misc_feature (71): n=a or g
ctgtttgttcctttctgaatggttgttgcatcttcagagagcatattgatattaaatagccgtggactgcnaaagacatcaattgtgagttgatgtgttgt

SEQ ID NO: 49789 - DNA, 101 bp, rice(Oryza sativa)
  misc_feature (71): n=a or c
cgactgatgccacaacttgcacctctggttcggtcactttaatctccatttggacatctggcactgcaatntccatgggcacctccggcacttcaatctcc

SEQ ID NO: 49790 - DNA, 101 bp, rice(Oryza sativa)
  misc_feature (71): n=a or g
tgattttcttcgcatttcagaagagtagaatgtccatgaacagttaaatgagaaaaaaaagacagcgtgcnctaaatcacatatcatcgaaatgtgaatac

SEQ ID NO: 49791 - DNA, 101 bp, rice(Oryza sativa)
  misc_feature (71): n=a or g
ttagggctcatcgaacaagcccttgctacataataaattgagcacaaaaaccacagctgtgttcggatatngggagttgggaactaaactccccgcacgga

SEQ ID NO: 49792 - DNA, 101 bp, rice(Oryza sativa)
  misc_feature (71): n=t or c
gccattatgatgtcccatctccgctaccactgagtcatctgtgctctgaagcattgcatattgttgtcctngatgcctctgatagaatcaaacagaagtat

SEQ ID NO: 49793 - DNA, 101 bp, rice(Oryza sativa)
  misc_feature (71): n=a or g
cacacagtcgctcgctagcgaagcacgcgatctcgcaattcgcaagcaaaccaaccaaaccaagaaaaccnaggaagaaggaggcgaaagccattagccat

SEQ ID NO: 49794 - DNA, 101 bp, rice(Oryza sativa)
  misc_feature (71): n=t or c
aagtctggcattgcaagaactggggcagtgactaatgcatgcttcaatgcctgaaaagccttttcagtctnatcagtccacatataaatttgcccttttct

SEQ ID NO: 49795 - DNA, 101 bp, rice(Oryza sativa)
  misc_feature (71): n=a or g
tggagcagcttacatcattgacatcccttgatttcagttgctgcagttgggacagattgccggagaatttngtgaacttgacatctctggagaatttgcgt

SEQ ID NO: 49796 - DNA, 101 bp, rice(Oryza sativa)
  misc_feature (71): n=t or c
catgctgccaagccttcctcaaaccgaaggactagactgctgaagaataatcacaaagaaaatcttgctcnattagttttgtatctgcccttagtattcgg

SEQ ID NO: 49797 - DNA, 101 bp, rice(Oryza sativa)
  misc_feature (71): n=a or g
aggcgggtgaggcaaggaggtgatttctcccccttgacagcttatgctcttgtcccactcggttgtttgcntcatgtccatggtgatggtttcttgggctt

SEQ ID NO: 49798 - DNA, 101 bp, rice(Oryza sativa)
  misc_feature (71): n=a or g
cagcctaagcagactggtgaccatatgggcatcaacatcaacacagtcactttttcgactaacacaacaantgtatccagcttcagcccgaatgagagcat

SEQ ID NO: 49799 - DNA, 101 bp, rice(Oryza sativa)
  misc_feature (71): n=a or g
tcccacctacgcccacatgcccccctcctcgcgaaaacctaggaataacagttggagcgtcagcttcaggncatcaacaagttcaccccgcattgtcctgg

SEQ ID NO: 49800 - DNA, 101 bp, rice(Oryza sativa)
  misc_feature (71): n=a or g
gttcatggatgggctatatatcggtcagttcatggatcggtcagttcagggatgtttggtacacttatatngatttgaaggcaactccgagggatccacac

SEQ ID NO: 49801 - DNA, 101 bp, rice(Oryza sativa)
  misc_feature (71): n=a or g
attttataaaaaatgtttattcacttgtatatccaagttattttcagttgtaccaattggctcattttctngttgtttgatgctttcattggtagatctaa

SEQ ID NO: 49802 - DNA, 101 bp, rice(Oryza sativa)
  misc_feature (71): n=a or g
tttcgtacttctcaacctcctctttaagggtcttggtactgtattcaaatccttcaaagcgcagagctgcntctctcagcaaggtattgagtttagcacca

SEQ ID NO: 49803 - DNA, 101 bp, rice(Oryza sativa)
  misc_feature (71): n=a or g
aaacaagctataaaacccaaaaaaaaatacatatgtatgttcgtacaaccatcgacaaaaaatatagacantcctcaagataagattttatatacaataaa

SEQ ID NO: 49804 - DNA, 101 bp, rice(Oryza sativa)
  misc_feature (71): n=a or g
tgaaccaggagcccatggcacaggaaatggagcctctctacaagaagccaacagtgaagaagataaatctngatcaaccgagaaggacatgcgggagtact

SEQ ID NO: 49805 - DNA, 101 bp, rice(Oryza sativa)
  misc_feature (71): n=t or c
atgtatctaattgactatacaattcagatcgagttataggagtatgctactactaagattgctcatataanatttaattattttctgagaacatgcaggag

SEQ ID NO: 49806 - DNA, 101 bp, rice(Oryza sativa)
  misc_feature (71): n=a or g
acgagcgaatgggctcttctcatccttatctcgaacaatagtggacgaccccttgcgtttatttttttcgnggttcactgtctctgcaggttttggtacct

SEQ ID NO: 49807 - DNA, 101 bp, rice(Oryza sativa)
  misc_feature (71): n=a or g
tccagttgaggtgtccaagaggttcatccaaagctatatccacacactgttggaaatccggcaaaactctntgatcaacctagagaagggcaagcactttg

SEQ ID NO: 49808 - DNA, 101 bp, rice(Oryza sativa)
  misc_feature (71): n=a or g
atttaattatgaaagaattaaatcctacatgctacaacctgttaacaaatactaaggctgagattaacacntaattaattaagtattagcaaaaaaaataa

SEQ ID NO: 49809 - DNA, 101 bp, rice(Oryza sativa)
  misc_feature (71): n=a or g
gggcagagctggacgcactgtacatgaccacgtcactacgacgacgtcctaggacgttacacgtcggtgtncagggtgagagcaagcctccacggcttcga

SEQ ID NO: 49810 - DNA, 101 bp, rice(Oryza sativa)
  misc_feature (71): n=a or g
atgagagaggatgatgacaaagaagtagttgctcaagcttgcacgagcttagcagacatcgtgagggattntggatttgccataattgaaccttgtaagct

SEQ ID NO: 49811 - DNA, 101 bp, rice(Oryza sativa)
  misc_feature (71): n=a or c
agggtcatttataagcactatgaagttcctcgtaagtggtagaatggagagacagcaacacgctaagaggnacatcaaacggcaatatcccttcattgcct

SEQ ID NO: 49812 - DNA, 101 bp, rice(Oryza sativa)
  misc_feature (71): n=a or g
gcatggtaaaagctactagcattggccgcatcgtacatcaacgtttgcagcgatcaaagcgtgctgttgcngtgcattggaccgtagcctgtggttgactg

SEQ ID NO: 49813 - DNA, 101 bp, rice(Oryza sativa)
  misc_feature (71): n=t or c
acaaaaattccactcaactacccttcactcctcctctcctaccgttctttctcatcccccatcttcctccngatccaacctagctgcgggggcggtgaacg

SEQ ID NO: 49814 - DNA, 101 bp, rice(Oryza sativa)
  misc_feature (71): n=t or c
aacctaccaagtacagttgaacttgcgatacatcagtagcctaccttgtcatcaggaagaagttgggctcnttcacgagttggagcatcaaaatccacatg

SEQ ID NO: 49815 - DNA, 101 bp, rice(Oryza sativa)
  misc_feature (71): n=t or c
attgaaaataagctccagcagcttcattactacagccaagaacagtggaagctttaggatttcagcatatnggacaagctaccaaatgatgaacaatacta

SEQ ID NO: 49816 - DNA, 101 bp, rice(Oryza sativa)
  misc_feature (71): n=a or g
ctgttaggtttttgggataactgctgaagctaaaccaagtcttgaaggccatgttttccctaaccctgttnaacctgatggttatatggtgatgctgtgct

SEQ ID NO: 49817 - DNA, 101 bp, rice(Oryza sativa)
  misc_feature (71): n=t or c
cagatgagttagctagcatccaatgtgatgtactacatctcgatcaattggtcaaattgaacgcaacgtcntactacatagatactgtacatattttaaca

SEQ ID NO: 49818 - DNA, 101 bp, rice(Oryza sativa)
  misc_feature (71): n=t or g
tactcctagcttagctagatagctaaccaccctatgctcaccaaatcaaatgcatgcatgcatgcatggcnccatggactacttacttactactaccattg

SEQ ID NO: 49819 - DNA, 101 bp, rice(Oryza sativa)
  misc_feature (71): n=a or g
ttagggaagttaaatatatggtttactaggaagcattcccgagtgacaatttatggtttatgtagcactgncatcctccctataaaagggcccatgcaatc

SEQ ID NO: 49820 - DNA, 101 bp, rice(Oryza sativa)
  misc_feature (71): n=t or c
tacctcttttctttctgggcatatgaacccacactcctcaaaaaaattcagagcttcatttcgagggccanggtatataattttcccttctgccattaata

SEQ ID NO: 49821 - DNA, 101 bp, rice(Oryza sativa)
  misc_feature (71): n=t or c
aacagcagcatttgcagtcagaaatcactcgctatcatatactcctatatacgtacagcatttgggcaaancctatgacgtacattttatggattcagaag

SEQ ID NO: 49822 - DNA, 101 bp, rice(Oryza sativa)
  misc_feature (71): n=t or g
ccaggaactagctagatcattgacacacagtgctgcattgacgtgtaacaatctatagcgaaatcaacganataagcatgcatatagtcatcttttgtcaa

SEQ ID NO: 49823 - DNA, 101 bp, rice(Oryza sativa)
  misc_feature (71): n=t or c
gaattattaaatcctttggaaaagaaaatcaagggggatgagattagacttccttgggcagctcagggcgngccccgatggcttgcgcggctcagccgggc

SEQ ID NO: 49824 - DNA, 101 bp, rice(Oryza sativa)
  misc_feature (71): n=a or c
ccttcaaatattatatttagcaaatcaacttttccaagtggttcaaagcgaaacttacaacaatccatcantgcctgcaaaacaattgaaaggataacatg

SEQ ID NO: 49825 - DNA, 101 bp, rice(Oryza sativa)
  misc_feature (71): n=t or c
agctactcccaaccgatgccaaaccgttgttttgcgatattcgccatctcacatgatttccaccttttttngcattaagcctgaccaaaataccccttcgc

SEQ ID NO: 49826 - DNA, 101 bp, rice(Oryza sativa)
  misc_feature (71): n=a or c
accatatatacgaaataaagggaaggatctcaggaagctccctgtcatgtaccatcgaagctgagaaattntatcttactatcaagttacaacccattaaa

SEQ ID NO: 49827 - DNA, 101 bp, rice(Oryza sativa)
  misc_feature (71): n=t or g
agcctggccgagacccgagctggagatggagattgtagtgggaaaaggtgaagcggtgcagtgacgactgnctgccacaagtggaggccgcggcacgcgcc

SEQ ID NO: 49828 - DNA, 101 bp, rice(Oryza sativa)
  misc_feature (71): n=t or c
tgccatcacgtgccctctgcacaagcagcccagcccgtcgccagtttcctctccccacatccacctccggntgctggcattgctcgcgtgccagcacgtgc

SEQ ID NO: 49829 - DNA, 101 bp, rice(Oryza sativa)
  misc_feature (71): n=t or c
ttagatgcaacagtaacagacattgtatatatacacctgtagtgacctagcacaggcgacaaagaactaangggagatttgctccgttctaacaaaaagta

SEQ ID NO: 49830 - DNA, 101 bp, rice(Oryza sativa)
  misc_feature (71): n=t or c
aggacacatctagtacaacgaatctgaacatatatatcccatccagtataatattgttatttttttagganggagggagtatgtctttaatttttcagttt

SEQ ID NO: 49831 - DNA, 101 bp, rice(Oryza sativa)
  misc_feature (71): n=t or c
ttctttatcagcatgatgattgagaccaagaaggataggaaaaggtggagagttgttaatgtatatgggcnagtacaggctgacaggaaggaaaaatttct

SEQ ID NO: 49832 - DNA, 101 bp, rice(Oryza sativa)
  misc_feature (71): n=a or g
atcatatttagacaatgtttatgttccacatctgtgaagcagtcagatatccggagagtacacaattgctnctaaggatcggaatggcacgttatcttgca

SEQ ID NO: 49833 - DNA, 101 bp, rice(Oryza sativa)
  misc_feature (71): n=t or g
tctgcaactccaaaataaaaagaaaagccaaacaagcagaaactgtggcatatttcacaccaatctgccanaattcattacactaaatgaacagccaagtt

SEQ ID NO: 49834 - DNA, 101 bp, rice(Oryza sativa)
  misc_feature (71): n=a or g
aagttcaaaatgataggctggttgtgctttcagcatttcatgatcatcttcacaatcaagttcaaattganttgcatcctcatcaccagaatcaatttcag

SEQ ID NO: 49835 - DNA, 101 bp, rice(Oryza sativa)
  misc_feature (71): n=t or c
atattttggtgtaggtggtaatagaagagataccggcagtatcgatgacaagaaccccgggcagtcgacgngcaccacaaagacacaggaagaggagagtg

SEQ ID NO: 49836 - DNA, 101 bp, rice(Oryza sativa)
  misc_feature (71): n=a or g
gtgagcttatcaagttttgcgatccaatctggaacatatgagaagacgacctcgaaaacatgaagcctgcnaagatggagcggaggaggggaccaaaaatt

SEQ ID NO: 49837 - DNA, 101 bp, rice(Oryza sativa)
  misc_feature (71): n=t or c
ttttttcttcttgttggaagaattgatgaacttgaaactgcagccttacttgtaagttcttgccaatgatnctggaatcgggccactcaggttgttatatg

SEQ ID NO: 49838 - DNA, 101 bp, rice(Oryza sativa)
  misc_feature (71): n=a or g
ctcgctgatgccggcgactacatcagtgagctgagtacgggaccatgagtccatgacgtacacaagcccanctcttgctcttacctcatgttttattcttc

SEQ ID NO: 49839 - DNA, 101 bp, rice(Oryza sativa)
  misc_feature (71): n=t or c
ctccctgaattatgtgatttatatgggcatgtatgcttatttaatcttactagtagggatgaaagtggtanggatagtttccgagttccgaacctgttttc

SEQ ID NO: 49840 - DNA, 101 bp, rice(Oryza sativa)
  misc_feature (71): n=t or c
attcagatagtcctcccaatctatataaagaaggaaacctgaaccctagcactctactcacctcgccgcancccttttcttccttccccaaactcaagccc

SEQ ID NO: 49841 - DNA, 101 bp, rice(Oryza sativa)
  misc_feature (71): n=a or g
atacttgttggctgatcagcctttggaggcatgtgtccagatttagacctagtattgggttcttttttganagggagggagtatatatcttgtgataaggt

SEQ ID NO: 49842 - DNA, 101 bp, rice(Oryza sativa)
  misc_feature (71): n=a or g
aaataattttcctgtacaggactcactttatattgcagacggactgtaagtggtcgcgtctgcaaaaatcncgctccattttcgtgtgcggttctttaaaa

SEQ ID NO: 49843 - DNA, 101 bp, rice(Oryza sativa)
  misc_feature (71): n=t or c
tagaataccaacattgagaaatcacatctgtcacgtttgtaaactccaagcagatcgagagtctacggcanatatactgaccttgaatcttgagagaatgc

SEQ ID NO: 49844 - DNA, 101 bp, rice(Oryza sativa)
  misc_feature (71): n=t or c
gcgatgagcgggagcgcccgccgaggttacagagtattcatcgaggcgacattatatatccgaccgacgangacgagagctataccggcatctcgcctaag

SEQ ID NO: 49845 - DNA, 101 bp, rice(Oryza sativa)
  misc_feature (71): n=a or c
ctccgccagctctctccacctctggcggcggcggcggctcgttgaacacggcgtcatgcatgagtcaatcnccacgatctcgccggtggtgtcgtcctccc

SEQ ID NO: 49846 - DNA, 101 bp, rice(Oryza sativa)
  misc_feature (71): n=a or g
cggtaggaagtgttacgggtcgatcgtcactgatggctccggtctgcatctccgacgagcgttcagttgcngtttcggcggagcggttttggaaggtcttc

SEQ ID NO: 49847 - DNA, 101 bp, rice(Oryza sativa)
  misc_feature (71): n=t or c
ttgttgcttctttatcttttcattattagcccctatagtttcaagaagttgagcaggtatggtcttttcangcattgtcatatagtataatgtaatggaaa

SEQ ID NO: 49848 - DNA, 101 bp, rice(Oryza sativa)
  misc_feature (71): n=t or c
tctgatactgatgtcattatagctgaaatctttgcatacgctgaatatgcacaactcatagcttggatacntgacaagatggaagcagcccattctttgtc

SEQ ID NO: 49849 - DNA, 101 bp, rice(Oryza sativa)
  misc_feature (71): n=a or c
agtgacttaccgctaatgccaaaatatcaacctcacaggtgcctagccagtcaggaacttttctactttgnttggtatgttttccacacccttctcatgaa

SEQ ID NO: 49850 - DNA, 101 bp, rice(Oryza sativa)
  misc_feature (71): n=t or c
aggcaataagctttgtccagctgaccctctctaagcaagccgttgatgactgtggtgtatgaaaccacgtngggtgggcatcctcctctagtatcatcagc

SEQ ID NO: 49851 - DNA, 101 bp, rice(Oryza sativa)
  misc_feature (71): n=a or c
agagtattgagtcactttttcttgatctatcaacactccgaatcgcaacagataacttctccgaaaataanaaacttggtgaaggaggatttggtgttgtt

SEQ ID NO: 49852 - DNA, 101 bp, rice(Oryza sativa)
  misc_feature (71): n=a or g
gaaaatgggaggcttccatttgatggggatgccattgacagaagacaaatggtagagcgtcaaggcaccangttggagccattcgtagccgaggctgaatc

SEQ ID NO: 49853 - DNA, 101 bp, rice(Oryza sativa)
  misc_feature (71): n=a or g
gtctcaatcaggccttaaagtgagcccgtcacggacgactaatatcttaatcggaattaaaaccagtcccnttaccgataggtttgaccagcagatgagtc

SEQ ID NO: 49854 - DNA, 101 bp, rice(Oryza sativa)
  misc_feature (71): n=a or g
gaaaatggaagaaggagaagggataaaatgccctacttgcccattgcctcagctcaaagatttgtaccacngcgaggccgaggcggaggcggaggcgaagg

SEQ ID NO: 49855 - DNA, 101 bp, rice(Oryza sativa)
  misc_feature (71): n=t or c
aaaaaatcaagacacaaaaataaggtttcctgacctgttcctttatctgtgagttttacaataatttcacntatagtaggtcgtttctttggatcggtctc

SEQ ID NO: 49856 - DNA, 101 bp, rice(Oryza sativa)
  misc_feature (71): n=a or g
agccttcagggatcaggattctggtagtaataagtagagtagtagatcgagaaacacacgggggtcttccngctagctccgcaaagtggtgggctagatga

SEQ ID NO: 49857 - DNA, 101 bp, rice(Oryza sativa)
  misc_feature (71): n=t or c
tgccgctgccatgggtccacttgcttcacaccgatgataagaacactgtttaactgttgaccgtgcttggngagagctttttgtgcatcatgccggctctg

SEQ ID NO: 49858 - DNA, 101 bp, rice(Oryza sativa)
  misc_feature (71): n=t or g
ggtccactatttatgcacttccaagctctatcgggaaattacagaacttacaagttttggacataagaganagtgaaatttctacactaccaactgatatc

SEQ ID NO: 49859 - DNA, 101 bp, rice(Oryza sativa)
  misc_feature (71): n=t or c
aggcacacccaggcagtatacaacagcggacaaggcctagctaggtaccatgaatacatgcacggtcgatntgcgaatgaccggtactagtgccatgcgtc

SEQ ID NO: 49860 - DNA, 101 bp, rice(Oryza sativa)
  misc_feature (71): n=a or g
cttaatgttttcaaattgtatcctaacattgtggaaccagtatggtactaattcatctgatcccgttgctnggaggaagagaaatgctcaaatagtatgat

SEQ ID NO: 49861 - DNA, 101 bp, rice(Oryza sativa)
  misc_feature (71): n=t or c
catgtgtgagggttcgtaactgccactcatcatagatcatagatatgtgtgatgtgtcgtagttacgagcnattacgatgacgggtcataaatatctttga

SEQ ID NO: 49862 - DNA, 101 bp, rice(Oryza sativa)
  misc_feature (71): n=t or c
gcatagaatttcatctggcatgcagatgtcaacaaatcctaaccactatccggtatttccacattcattcngcaaccaacatgtggtctcattccaaacaa

SEQ ID NO: 49863 - DNA, 101 bp, rice(Oryza sativa)
  misc_feature (71): n=t or c
tccccgtccggatttggcgacgacgacgacgagctgcgacgcagctagggttttgactttttatttttttngcaatatttacttttcttttttgttttttg

SEQ ID NO: 49864 - DNA, 101 bp, rice(Oryza sativa)
  misc_feature (71): n=a or g
ctgggagaagttcattgttagcatcaaagcataaagattgtacatccacatgataagccatatcagggtcnctatgacgaaatggctcgagggggaaggca

SEQ ID NO: 49865 - DNA, 101 bp, rice(Oryza sativa)
  misc_feature (71): n=a or g
cgaggcatatatgcatcacacgtctagtagccctgtacgagtatattgtttaatgacatggttggaaatgngagattggaatgacgaagcgctagaagcaa

SEQ ID NO: 49866 - DNA, 101 bp, rice(Oryza sativa)
  misc_feature (71): n=a or g
aggtctctagtgaggcttagggatctctacatcggtggctgtaagcaattagttcgcttggaaggcctganccatcttgatagcctggagcaccttaccat

SEQ ID NO: 49867 - DNA, 101 bp, rice(Oryza sativa)
  misc_feature (71): n=t or c
cttccttccgttcaatctccaccttgacatcagcaacagagttggagttcttcacaatgagtttaatggtntttgcaatcgatgggatcttgacatatata

SEQ ID NO: 49868 - DNA, 101 bp, rice(Oryza sativa)
  misc_feature (71): n=a or c
gggcatgtatgcttgctagctagggcatccacagtgtgctcccaagccaagtaataggaaatattttaatncttatatcacgtagtactaaatattatgga

SEQ ID NO: 49869 - DNA, 101 bp, rice(Oryza sativa)
  misc_feature (71): n=a or g
tgaaatacaataacctggctcagatgtaaatgtgacactgtgagtgttatcatcaacatggttaggcaganaatcatttatctcagtcaacagtctttctt

SEQ ID NO: 49870 - DNA, 101 bp, rice(Oryza sativa)
  misc_feature (71): n=t or c
ttgggatcgcttggggcggtctgaataaagaacactttgccgaataagagttctagctccagctactgtangtccatgtctcctggcaaattctgctcgtc

SEQ ID NO: 49871 - DNA, 101 bp, rice(Oryza sativa)
  misc_feature (71): n=a or g
agtcaaactcgtagtattaacgagtcgagccaaactgatgagcaactagagataaaaatggagcctctganttgccatgggtttggatggactggtttcat

SEQ ID NO: 49872 - DNA, 101 bp, rice(Oryza sativa)
  misc_feature (71): n=a or c
tggaactatagacctgtgccactgtaacttctgactgtttactgcttttctacccaggaatatgggcacanggcatcacattatcatggtagcatggatcc

SEQ ID NO: 49873 - DNA, 101 bp, rice(Oryza sativa)
  misc_feature (71): n=t or c
tttagaattgtcacttacgattgctgcagccaaccacggattgtataaattccttttgtcgttcaccctcngcaacaatgttgggcctaggctggcttgtt

SEQ ID NO: 49874 - DNA, 101 bp, rice(Oryza sativa)
  misc_feature (71): n=t or g
gatagctttgcccagcccccaggttgtgtatgaaactgggtggttgcttgtacgctcgtagcaattcctanaagatatcaactttaaacactaactaatta

SEQ ID NO: 49875 - DNA, 101 bp, rice(Oryza sativa)
  misc_feature (71): n=t or c
gtcaatggcagccattgctggagctggtgaatgtactcgctctcgacgtgtgattggaacgagttggaatncaagaaaacctcgtcgcagacggggcacag

SEQ ID NO: 49876 - DNA, 101 bp, rice(Oryza sativa)
  misc_feature (71): n=t or c
gatgacataactacctacaattgttatacgatgcacataaaagctagaactttaagcattccatcatcatngaagtaaaacacacagcagaagtatctttt

SEQ ID NO: 49877 - DNA, 101 bp, rice(Oryza sativa)
  misc_feature (71): n=a or g
ttttatatcctcgggtccgttctgacagactgggcaacctcccgaatcacccacatgtcgatttgcaagantcgcccggcacggcactaaacctttgagtg

SEQ ID NO: 49878 - DNA, 101 bp, rice(Oryza sativa)
  misc_feature (71): n=a or g
aaatacaataaactcagttgggattgtattgatggtaaacttctcggagcaccgacaaccactagctgtcnttccacgcactgtcaccaccgctctttctt

SEQ ID NO: 49879 - DNA, 101 bp, rice(Oryza sativa)
  misc_feature (71): n=t or c
gctccccctaccaggtcaacggcagcaacaagcccaacggggagcagctcatcagctggtttcaagccaangtcgttccctccccctcctcctgtccttcg

SEQ ID NO: 49880 - DNA, 101 bp, rice(Oryza sativa)
  misc_feature (71): n=t or c
acactttctgctccctatttagccatacaaaatagtcgttgttccacctcttggtcgaatgtagatttatntggagaatatagaaccttattacaacttaa

SEQ ID NO: 49881 - DNA, 101 bp, rice(Oryza sativa)
  misc_feature (71): n=t or c
cgagttcagggtcgccaccggcggcgaggtctcctaccagttccgcaaccttgacggctcgccgatgtcangggtgctcctcaacgaatccggcgtcatgc

SEQ ID NO: 49882 - DNA, 101 bp, rice(Oryza sativa)
  misc_feature (71): n=t or g
accctagttccccagcgccaacaccatgtctagccggatgaagagggaggtggagccgcctcctcagatcnttgtgagatctactggtcctctcgctgttc

SEQ ID NO: 49883 - DNA, 101 bp, rice(Oryza sativa)
  misc_feature (71): n=a or c
ttggaatctttcgctttgccgacaatccattgtccctcgctgctgtgtagtagccactcctgtggctcggntgggaaaaataggctgcccgtctatttgtt

SEQ ID NO: 49884 - DNA, 101 bp, rice(Oryza sativa)
  misc_feature (71): n=a or g
acggatgtgctgctagtttgcttttaccatcatttttttgttttttccagtttggccaaccaagacagatntattaaattcggttagttacaatcagtgac

SEQ ID NO: 49885 - DNA, 101 bp, rice(Oryza sativa)
  misc_feature (71): n=a or g
cccaccactaaatcaagcctagaatcaagccatgttcgacccaacagtggtaatgcaagctacttcgacanatcagcaaaaccaagcaatgaagttcggca

SEQ ID NO: 49886 - DNA, 101 bp, rice(Oryza sativa)
  misc_feature (71): n=a or g
ttgtaaaaaaaaaaatccataccgtagtaaatatttttttccccaggagacgaagacctgatgaaccccgncgtataggatacgtatctccaatgcgcccc

SEQ ID NO: 49887 - DNA, 101 bp, rice(Oryza sativa)
  misc_feature (71): n=t or c
aggagggttacgaggacatatatcccgaaccgaaatctatgttttgtcatctaccccgtgcattcatatgncaggtgggagcaagcttgcagcagctggat

SEQ ID NO: 49888 - DNA, 101 bp, rice(Oryza sativa)
  misc_feature (71): n=t or g
atatgtcacagtgatccaatgtagtgttgaccatcacattcctatgggctatgggacgataccactgtaancccactaggggtttaatagatctcaattat

SEQ ID NO: 49889 - DNA, 101 bp, rice(Oryza sativa)
  misc_feature (71): n=t or c
tgctcattgaggccttcaaacacttgttggcactccaccgtccatcggaagggcgaggcccctcggagcanggcgaagagggggagacagctctccaccga

SEQ ID NO: 49890 - DNA, 101 bp, rice(Oryza sativa)
  misc_feature (71): n=t or c
tcatctaatcttctattagagtataatggttgatttcagaagggattttagagtagtggcacctgactttnggcgagcaatgcagcaagccagcaatgaag

SEQ ID NO: 49891 - DNA, 101 bp, rice(Oryza sativa)
  misc_feature (71): n=a or g
aaaatgtctgtatgaaggtaagcagttagcagatgaagagaagcaagaactcataccgtttaatctgttanctcgaatatagaggttctcccctccttggg

SEQ ID NO: 49892 - DNA, 101 bp, rice(Oryza sativa)
  misc_feature (71): n=t or c
acctgttgctatcctttgatggtacggtgttacttcttacccggaaaagaagttttacctccctttttttncatgtcagatgacatccgatatgtaattta

SEQ ID NO: 49893 - DNA, 101 bp, rice(Oryza sativa)
  misc_feature (71): n=t or g
ctttttctgcaagtccaacaaagtagagtactacggtgtactactactcctccacttgtctattgcatttncaggtttttgcagcacgcttcataggcatt

SEQ ID NO: 49894 - DNA, 101 bp, rice(Oryza sativa)
  misc_feature (71): n=t or c
agacgattttcaggtttgttctgtacaagttggtgctggatattttctgtacagggatatggattttcatncgtggttatttgtatgtcatctaaatagtt

SEQ ID NO: 49895 - DNA, 101 bp, rice(Oryza sativa)
  misc_feature (71): n=t or c
ctactcactgctacttgctccgtacaaaaaaaaatcaaaaactggatatgacatatctatcatagtacaangaatctgaaaagaggactgtccagattcat

SEQ ID NO: 49896 - DNA, 101 bp, rice(Oryza sativa)
  misc_feature (71): n=t or c
aattcccttatagtatggcatggagggagtacaatgtatatggaagatgagacattagtctgggtcccacntaatcaacatccatgagagggggaaagagg

SEQ ID NO: 49897 - DNA, 101 bp, rice(Oryza sativa)
  misc_feature (71): n=a or g
tgaagtttgcctggcactcattggcaattgccttggccaacaaggtcttaccacagccaggagggccatanaacagaactcctttggatggagacattcca

SEQ ID NO: 49898 - DNA, 101 bp, rice(Oryza sativa)
  misc_feature (71): n=t or c
ttgtaccagaagctggaagtgcttcgtttaactttgcaggaggacctgtagactgtagtggaagatgtagnactgacactgataagttaataataataacc

SEQ ID NO: 49899 - DNA, 101 bp, rice(Oryza sativa)
  misc_feature (71): n=t or c
gtgttcacgtggacagggtgctgtttggattggttgatctgatgaacagggaaaatccaaaggttccgggnaatagcatgccgaagacgctgatggatcaa

SEQ ID NO: 49900 - DNA, 101 bp, rice(Oryza sativa)
  misc_feature (71): n=a or g
tttgtcaaaaatttcatatatacatataaacataaccatgttacttaccaaagcatcactccagacgatancgaaagcttcataatagcaccaagatcagt

SEQ ID NO: 49901 - DNA, 101 bp, rice(Oryza sativa)
  misc_feature (71): n=t or g
tatagctacaccctttttttttctaaagaaaagtgacgacctgactttgagttccagatggaattggaccngatgacctcaagctgggcacggtgctcgac

SEQ ID NO: 49902 - DNA, 101 bp, rice(Oryza sativa)
  misc_feature (71): n=t or g
gcgagaagaacatcatccttgtaaaagttgaagatctttctgaggaacaaagggcggatatggaacaaatnatacaacagttcagagatacctatctaaat

SEQ ID NO: 49903 - DNA, 101 bp, rice(Oryza sativa)
  misc_feature (71): n=t or g
cgccgccggcaacatcaccaagtacaaagcacgcctggtcgcgaaggggtatgtgcagcggcaaggcatcnacttcgacgaggtgttcgcaccagtggcgc

SEQ ID NO: 49904 - DNA, 101 bp, rice(Oryza sativa)
  misc_feature (71): n=a or g
tcaaacaacttcttgatgcgcggtgtggcacggttcaggtagagatggctaaacccactcatgacatgacnaaagaacgagatgtgtgctatcgtttcatg

SEQ ID NO: 49905 - DNA, 101 bp, rice(Oryza sativa)
  misc_feature (71): n=a or g
tgacgatgggggcaagccagcttctgaagcggcggttgctgaagatgagctgccgtacgacgagtggaaantacagcgcagagcgcttctggatcggctgt

SEQ ID NO: 49906 - DNA, 101 bp, rice(Oryza sativa)
  misc_feature (71): n=t or c
cgaccaaatatagttgttctcaactcttttgtgacctcctgtatgctggcagaatcttggatgtgcgcttnaccatgagagcacgagctgggatatatggc

SEQ ID NO: 49907 - DNA, 101 bp, rice(Oryza sativa)
  misc_feature (71): n=t or c
gtgcaaatgtctggaactctggatgaggagaataggggatgagatctcaccatgatatgcaacgtctcganattgggaaagcatctcaggaaggagagcag

SEQ ID NO: 49908 - DNA, 101 bp, rice(Oryza sativa)
  misc_feature (71): n=a or g
ggagttggtcccaatcatgtcagccatcaactgtgttgtcggcatccggtagcaactccaacgccttttgnccacaccccgcaacatggtgtcgacggacg

SEQ ID NO: 49909 - DNA, 101 bp, rice(Oryza sativa)
  misc_feature (71): n=t or g
gtggggtcattttattttacatgatatatggagcacaatactctctcttccagtgcaatggagtttgcatntgccttagtacattgcggtatttatcttcc

SEQ ID NO: 49910 - DNA, 101 bp, rice(Oryza sativa)
  misc_feature (71): n=t or g
atatcccatccattgagttccctgtccccacccacgttgacatgcatgactgatcacctgcttcatgtaangccagtcacaatggctagtgtcattgcacg

SEQ ID NO: 49911 - DNA, 101 bp, rice(Oryza sativa)
  misc_feature (71): n=a or g
ggaagtcgccttcgtggctgccgccaccaatctagaagaactcaatggcacagtggaagaggtcgacggcncggaggagcttgtggcgccggaaaaaggaa

SEQ ID NO: 49912 - DNA, 101 bp, rice(Oryza sativa)
  misc_feature (71): n=a or c
aatcctcgcctctcccaagtcatcttcttgccttgctcgcgtttctcaattattttccctctctctttttnttaagtggtttttccatctttctcttaatg

SEQ ID NO: 49913 - DNA, 101 bp, rice(Oryza sativa)
  misc_feature (71): n=a or g
agtgtaagaacgtggtatttgagaacataatatccttgtctacctgctttggtatatgcaagctactggantacttcattcgtcccataaaaaataaatct

SEQ ID NO: 49914 - DNA, 101 bp, rice(Oryza sativa)
  misc_feature (71): n=t or c
ggtggccgtagcaatttccacatgaataaaaatcacgtgaacagaagggctggctgcctgcaggcaagtantataatgctccatatgctgcccataaatgt

SEQ ID NO: 49915 - DNA, 101 bp, rice(Oryza sativa)
  misc_feature (71): n=t or c
tacacggacacttggccaaagatagatcaagagaacgaggcggcaatggctcaacatctgctcattgcggnggaaaggtatggcctagataggctgaagct

SEQ ID NO: 49916 - DNA, 101 bp, rice(Oryza sativa)
  misc_feature (71): n=a or g
ctcgcacaccaccaccacttgcttgctagctgctcccacttggccgcacttcccacctggccatgcatgancccatagccaacagcactggcaccgtggca

SEQ ID NO: 49917 - DNA, 101 bp, rice(Oryza sativa)
  misc_feature (71): n=a or g
atgtactatgtgcagctataggtagattacatatcacagtcttgggcgtggattaatttttagttcacganaagaaaatttttaggtgtgatattgaacgt

SEQ ID NO: 49918 - DNA, 101 bp, rice(Oryza sativa)
  misc_feature (71): n=t or c
ggaagaggcggcggaactgcgttccatgcactacagctagcccaaatgaccaccctagtgcttcaactacnagacttcaacatggacttcatcgtcgagag

SEQ ID NO: 49919 - DNA, 101 bp, rice(Oryza sativa)
  misc_feature (71): n=t or g
atccaatccagagcggttttgtcctacgtggcataccattcagcatttgaaaaaattggtgggacccaccngtcatacctcctcttcacctcttcctaatc

SEQ ID NO: 49920 - DNA, 101 bp, rice(Oryza sativa)
  misc_feature (71): n=a or g
acgctgccccccgccgcattcacggggccgcgactgctctagtacgtgtgattgatctgcttccgaccagngcggatccagaaataaaaaattgaaggggc

SEQ ID NO: 49921 - DNA, 101 bp, rice(Oryza sativa)
  misc_feature (71): n=a or c
ttgtatatgtggagaagcattatttttggtagagagctgctgagcaagggcctgttatggcatattaccgntggtaaatcaatcaaaattaaaagagataa

SEQ ID NO: 49922 - DNA, 101 bp, rice(Oryza sativa)
  misc_feature (71): n=t or c
gagcagttgtatggtatagtggctgtacatacatatacgggcctaattattctctggcaacacttctctcnaggccggtcggccggtcaatccggccatgg

SEQ ID NO: 49923 - DNA, 101 bp, rice(Oryza sativa)
  misc_feature (71): n=a or g
ccgtgcctttgtgccgaggctttcgcctcatcatcttcgctcgcgcggccctctgacaaggtcttcgcttngtgaagttggcacattccaagccacggctt

SEQ ID NO: 49924 - DNA, 101 bp, rice(Oryza sativa)
  misc_feature (71): n=t or c
ccgcagtgcgtcgagtggatacttcagaaccaacaggaggacggatcatggggccattctgcagggccatnaggagaggtaaacaaagatattctattgtc

SEQ ID NO: 49925 - DNA, 101 bp, rice(Oryza sativa)
  misc_feature (71): n=a or c
gttttagcaccctatctcgtcatcaattaccagagggtgatatgctgatcatcaagcattctggttctcgncgcgctaattacagtatctgccacgcgcct

SEQ ID NO: 49926 - DNA, 101 bp, rice(Oryza sativa)
  misc_feature (71): n=t or c
gggaaaaagtcttgtactctgataagtctagcaatcgaatggaatgcaaaggccctaaaaatcagagtagntgtgggtaaagcggtacaagcctgcacagt

SEQ ID NO: 49927 - DNA, 101 bp, rice(Oryza sativa)
  misc_feature (71): n=t or c
tggagcagccatcactgccatcgtcatcgtgcagctgttaccgtcattgtcatcatcgcagcctccatcantgccatcatcgtcgcccctgctcccgtccc

SEQ ID NO: 49928 - DNA, 101 bp, rice(Oryza sativa)
  misc_feature (71): n=t or c
gttatttctaacagtagagaaagcaatatactcgacgaagtttaccagcccgaaaacggtatcggatccanctgagttgaatcacacttaacactatttaa

SEQ ID NO: 49929 - DNA, 101 bp, rice(Oryza sativa)
  misc_feature (71): n=t or c
agatagaagggataagttgaaaaaaattgaagtgtatgttaaagaggaacggaggaggtaactcaggcttntggacgggccattaaaaggcccgcttgtga

SEQ ID NO: 49930 - DNA, 101 bp, rice(Oryza sativa)
  misc_feature (71): n=t or g
actaagtgtgcaacaattgaattggatacatatgagaattttggaaagctgtcgaaatattttagtgacanccataggattatgtactccctcagtactag

SEQ ID NO: 49931 - DNA, 101 bp, rice(Oryza sativa)
  misc_feature (71): n=t or c
agaactggatggagatacaaacttcgtccatcccatccatcctccatgccaagtgttaactggatatattncattgcaaattttctcaattcaaaaactat

SEQ ID NO: 49932 - DNA, 101 bp, rice(Oryza sativa)
  misc_feature (71): n=t or g
cccatctctcctcttggttctcgacgcacttgctcaccggattcgcttgctcctcagtcctactggtgagngagtgggtgagtgagtgagcatggctgcac

SEQ ID NO: 49933 - DNA, 101 bp, rice(Oryza sativa)
  misc_feature (71): n=t or c
ttccggaagccgatctcgaaagaactctaaggttacttcctgggttcataagaactttcttaattcttccngggtgctagtctgtgtcctattaaagctgc

SEQ ID NO: 49934 - DNA, 101 bp, rice(Oryza sativa)
  misc_feature (71): n=a or g
cacaaagattgcctctttccttgaccctgatggctggaaagtggtatggctcctgtcttcgtgttccactntattttactactgttaaccatcgaatgatc

SEQ ID NO: 49935 - DNA, 101 bp, rice(Oryza sativa)
  misc_feature (71): n=t or c
ggaggaggaggagccccagacggtccaccgtggcaacgtcatagaggagcaggagcagctcaatgagcagnggcggcatgggggcgaggacggcgatggcg

SEQ ID NO: 49936 - DNA, 101 bp, rice(Oryza sativa)
  misc_feature (71): n=a or g
tatattcttctgtaccgaatagctgaatagatgaaaaatgtgataattattcgaggatataagcgaatganttaactattatagagttgaaaatagattta

SEQ ID NO: 49937 - DNA, 101 bp, rice(Oryza sativa)
  misc_feature (71): n=a or g
cggctagaggcatctttaaacaattttgtggttgattgtggttccattcgggcaagacttcgagaaattcncgctctgatcccggatgatctttcgaacac

SEQ ID NO: 49938 - DNA, 101 bp, rice(Oryza sativa)
  misc_feature (71): n=t or c
tctcagtttaccagataaatcaatttattttgttattaaactatttcgaatgaatgtattgatgacacgtnaaaacttgaaacggcgccttattcttagtc

SEQ ID NO: 49939 - DNA, 101 bp, rice(Oryza sativa)
  misc_feature (71): n=a or g
aaccttgaagtcttgaatacacacattattcagcttggcaagagcatcatggcatggaattctaattcctnctgcattcacacaccaagagacatgatgac

SEQ ID NO: 49940 - DNA, 101 bp, rice(Oryza sativa)
  misc_feature (71): n=a or g
cgacaccctcccctgtgccgccatcgccgagcaccgttacctccgtaaacgctacttcacggatggtcgcncgcgcccccgaccgtgcggcacagccacgt

SEQ ID NO: 49941 - DNA, 101 bp, rice(Oryza sativa)
  misc_feature (71): n=t or c
tgtcccacggctttccaacaagcagaactgcagcaaacgatcggcctctccaagcggcgactccacctaanggcacctgctgcgcctctccggccatcttc

SEQ ID NO: 49942 - DNA, 101 bp, rice(Oryza sativa)
  misc_feature (71): n=a or g
tattcttctctcgctctgacgagcttaattattgatattcgatgacgacagcggtggctctaaccagttangtatcggggtttggggttggagagggtctg

SEQ ID NO: 49943 - DNA, 101 bp, rice(Oryza sativa)
  misc_feature (71): n=a or g
gggaagcatccctttttatttttttgactcgtgtgggcacatcagtgctagttcttaaaccggcactaatnacgtccccctcccccaacaacacctcatca

SEQ ID NO: 49944 - DNA, 101 bp, rice(Oryza sativa)
  misc_feature (71): n=t or c
aaattgcacatctcacataaagaaacctaatatcacatcacatctccttctaaatttcactaagtcacaanaatcctaataattccacatatcatcaagtc

SEQ ID NO: 49945 - DNA, 101 bp, rice(Oryza sativa)
  misc_feature (71): n=a or g
cagaacaatatttggcactagcatattgatctctgttctctcttgaaaaatactttaggtatactcccacngaacctcatgttaagcatgtaagctgtgag

SEQ ID NO: 49946 - DNA, 101 bp, rice(Oryza sativa)
  misc_feature (71): n=a or g
tgctttctaacaaagtggatcatttgtatagtgatcaatactgaccgggcaatatcttctgcatagcctgnatgtggatttaacagtcttatccaattgcc

SEQ ID NO: 49947 - DNA, 101 bp, rice(Oryza sativa)
  misc_feature (71): n=t or g
attaatagatggcataaatacttgttgataagctttcctcaacatccgtaccttcatttatgaagtgaganaaaattatataagacagaaaaaattataat

SEQ ID NO: 49948 - DNA, 101 bp, rice(Oryza sativa)
  misc_feature (71): n=a or g
tcgcttcatcaatggggattgggagcaacaagagcagcggcaacacaggccggagaaacattgtgaggagnggactgcacgagcaccagagcaccgcgagt

SEQ ID NO: 49949 - DNA, 101 bp, rice(Oryza sativa)
  misc_feature (71): n=t or c
agtactattctgaggacacaggtcaggatcatgtttcatttgtgttgcaattgcaatcttggaattgcacntgctatgctactattgctatatagttgtac

SEQ ID NO: 49950 - DNA, 101 bp, rice(Oryza sativa)
  misc_feature (71): n=t or c
ctggttcaactgttggagcatccacgtctctaagagggaaagctacttaaaaagtactaactctgcaattntgtggtatcgtgtagacccatataaattca

SEQ ID NO: 49951 - DNA, 101 bp, rice(Oryza sativa)
  misc_feature (71): n=a or c
aatataagcagaaaactaatttaggtgattccggtgcaaccgtacatcaatgccctatgcagtaaaagaanatatctatgaaaacagtgaatgatgctgaa

SEQ ID NO: 49952 - DNA, 101 bp, rice(Oryza sativa)
  misc_feature (71): n=a or g
tgcatccttacgggcactggagaattagcaagaggcctttcgggagcaagcacttgtggaggcggagattncacttttggagctagcacttctgtaggagc

SEQ ID NO: 49953 - DNA, 101 bp, rice(Oryza sativa)
  misc_feature (71): n=a or g
atcttctgcaaggtttccttttcttctggatattattattgtttagatttggggcctgatatgatcctctnttttgattagtgtggcaccttaaaaataat

SEQ ID NO: 49954 - DNA, 101 bp, rice(Oryza sativa)
  misc_feature (71): n=t or c
cccgtggctggcgatggtggtgaaaggaggacggccgatttgggctttaggtctagatccggcgcgttctnagtcggggtcaagggtggtgcagaatccgg

SEQ ID NO: 49955 - DNA, 101 bp, rice(Oryza sativa)
  misc_feature (71): n=a or g
agacgacgtagaattattaccaggtgatagtggaagctcgatcgtttcatcctgcacaatgctggctgttnccatttcacttgtggtgccagtccagtcca

SEQ ID NO: 49956 - DNA, 101 bp, rice(Oryza sativa)
  misc_feature (71): n=t or g
atagaattgagatgattgtttatgtactgaccttttcttatgtttctgctgactgtcatctttaaatagtntcttagcagctgaggctgaggctgaggctg

SEQ ID NO: 49957 - DNA, 101 bp, rice(Oryza sativa)
  misc_feature (71): n=t or c
ggttgcgatgccaaaagacgcagtcatcatccgtccaaagaaattggacacggttttcacctagagacccncgtcgaggaaggagggtacctcggcaacac

SEQ ID NO: 49958 - DNA, 101 bp, rice(Oryza sativa)
  misc_feature (71): n=a or g
gattaaaatatgactatattttccacgtgctccaccttctctgtttcactgtcatcgctgccctcatgtcnatgttgagctggagccggaatgccggatcc

SEQ ID NO: 49959 - DNA, 101 bp, rice(Oryza sativa)
  misc_feature (71): n=t or c
tcaatcaaattggaatagaaaacgcacgatcgatatggagcgtcatcatcggcaactattagattaaatcngacgaaataaagctaggaaaatcatggaga

SEQ ID NO: 49960 - DNA, 101 bp, rice(Oryza sativa)
  misc_feature (71): n=t or g
gagaatcggcattaaccattcgttcaggcgtttggataaaatatcatacagtgatctgtacaaagcaacanatggtttctcttcaacaagtcttgttggtt

SEQ ID NO: 49961 - DNA, 101 bp, rice(Oryza sativa)
  misc_feature (71): n=t or c
tgggttcgggcttgggtgtgggctcatccagttgaatataactttagagagtgaaaaggaaaaagtacacngaaggtccctcaacttgtagtctagttaca

SEQ ID NO: 49962 - DNA, 101 bp, rice(Oryza sativa)
  misc_feature (71): n=a or c
tatgcctcataaccacatggtttttgtttattcggttgctaacttcgcttaccctcttcctctatccccgnagcttcggtgccaacagtggctctagaccg

SEQ ID NO: 49963 - DNA, 101 bp, rice(Oryza sativa)
  misc_feature (71): n=a or g
gccgccatagagaaaagaagtggcctcacaaggttgttaggcgtacgtagtatagaacacacggtattttngagcaaggataatagtgagcttatgtgaag

SEQ ID NO: 49964 - DNA, 101 bp, rice(Oryza sativa)
  misc_feature (71): n=a or g
acatgtatcatttgctttcgtttaatttgctgcagcattgcttcccatcagtcctagtttgagttgagtcnatcacactgtcaccaccatcagtttctttt

SEQ ID NO: 49965 - DNA, 101 bp, rice(Oryza sativa)
  misc_feature (71): n=a or g
gtcccgatgtcgaccgagaaggtatggagcatgcaactaagtctttcatcttgctgtaattgagaatttgnattgaagtcaagaaatttcatctcggcggg

SEQ ID NO: 49966 - DNA, 101 bp, rice(Oryza sativa)
  misc_feature (71): n=t or c
gtgttaggggaagcattcgcgggcagcatcttccgtgtaatcgagaaaaaataaagagaaaagttcatacnaggtattgggacatcaagaatctgcccctg

SEQ ID NO: 49967 - DNA, 101 bp, rice(Oryza sativa)
  misc_feature (71): n=a or g
agacggtacaagattagtgcaagggatattcggtcctttttctgatggattctgtagttggttgttgcgtnaaagcgacaccgtatgatttagaagaagaa

SEQ ID NO: 49968 - DNA, 101 bp, rice(Oryza sativa)
  misc_feature (71): n=t or c
atgtcttgatcctggggtatatttatcatcaccagtgataaacttctacattcagtaagaatgcaccttgntatcttttaagtttgagcttttaaccattc

SEQ ID NO: 49969 - DNA, 101 bp, rice(Oryza sativa)
  misc_feature (71): n=t or c
cccagctagttttacaaaatttccaggaaaaatctgcaggcaaaaattcaaaattgccttctctcacctcngactaagcttgaggagaaggggattgagaa

SEQ ID NO: 49970 - DNA, 101 bp, rice(Oryza sativa)
  misc_feature (71): n=t or c
catccccactacgacatttttttaagtagtagagataaccgctcgctaggtgctttggtgaatctgaatgnatgcatccattatatatttaagtgctcaaa

SEQ ID NO: 49971 - DNA, 101 bp, rice(Oryza sativa)
  misc_feature (71): n=a or c
tttttcagtggcagttgatgtgtctgttaagagcgatgtgcacatggattttagtggtaggtaatgtaccngttaacagcgatgcactcatgatgatttcg

SEQ ID NO: 49972 - DNA, 101 bp, rice(Oryza sativa)
  misc_feature (71): n=t or c
catgcatagcgccacatataacctctgaatgctccatggatcgatgggagttaaatttgttgttgcccagntccacaatcgaccatatttatatatacggc

SEQ ID NO: 49973 - DNA, 101 bp, rice(Oryza sativa)
  misc_feature (71): n=a or g
caaggtattcagaataaccagacttattgctccctaaaagaatggatgtcatgtatcatgcagaatgaaancaagacagaagcaaggagaaaggtgggtgt

SEQ ID NO: 49974 - DNA, 101 bp, rice(Oryza sativa)
  misc_feature (71): n=a or g
aagatcgatccaccgtccgagatagctagattcactagaagcaagccaagcgatcgatatgatgaacgacnaggaggaggagactactctgaggatggcgc

SEQ ID NO: 49975 - DNA, 101 bp, rice(Oryza sativa)
  misc_feature (71): n=a or g
cgaatagtttggatgagtagtacgtgcagaatttcatgccaagattctacgtaattttaaaaacgttactntttcagttgattcttttataagtggaagtt

SEQ ID NO: 49976 - DNA, 101 bp, rice(Oryza sativa)
  misc_feature (71): n=a or c
atactgtatgaacaacggagtgtatgaaggagcaatgttgcaagcaacgagagagagggataccatgttgngccaaatggcacagtgcaagctcaatgtgc

SEQ ID NO: 49977 - DNA, 101 bp, rice(Oryza sativa)
  misc_feature (71): n=t or c
tcccggccggcggccgccgctcgttcctcgcacgtctcgtctatgctcgcggagcgcctgatttcgtgctncgtgttcgacgccgcggcgcacgcaggtga

SEQ ID NO: 49978 - DNA, 101 bp, rice(Oryza sativa)
  misc_feature (71): n=a or g
agtcaagaacaatcctggcattgagacaactagacagcttgacattcatgcattctatagtactccacaancacaagctgtaagtggaaaactctaaaggt

SEQ ID NO: 49979 - DNA, 101 bp, rice(Oryza sativa)
  misc_feature (71): n=a or c
ttcttagagtacatgtgagaatctgtactgttcgagaacctggatcaaatagggtctttttacttgggacnaaatcaaaaacaccttacattccgaaacga

SEQ ID NO: 49980 - DNA, 101 bp, rice(Oryza sativa)
  misc_feature (71): n=a or c
catgtcagcggttgttactacagctgatagtgtatacctacccatacacatgtgtgctatctgcagctagntatgcacactccaaagcacatatgctactt

SEQ ID NO: 49981 - DNA, 101 bp, rice(Oryza sativa)
  misc_feature (71): n=t or c
caaatacaaagccctttcgaacaatgctaaaggcctgcgtccataaagcccgcttctcggaaggactgctngctaacgttttccgaactactaaattaaaa

SEQ ID NO: 49982 - DNA, 101 bp, rice(Oryza sativa)
  misc_feature (71): n=t or c
tctctccacatgtgggattgtggggcatgaaacttgtttctttcacactattgacgaatcaagaccttganagatacaaggtacatatagctatctttgcc

SEQ ID NO: 49983 - DNA, 101 bp, rice(Oryza sativa)
  misc_feature (71): n=a or g
gtttgtgttggaggcatgtcacaaggactatcagtcgaggctatcgaaacaaactatcatgctcctgggcnaagcacccgccagagcaaagacgggagcct

SEQ ID NO: 49984 - DNA, 101 bp, rice(Oryza sativa)
  misc_feature (71): n=t or c
atccacgactttgtgttggagaaggacaaggagagggagagggtgaggagaagattgaaccgctcaaccangcaccaccctatgccactgctgcccatcca

SEQ ID NO: 49985 - DNA, 101 bp, rice(Oryza sativa)
  misc_feature (71): n=a or c
actagggcattataacttgagtttgtacattattttaggttgctcttaaatcggaccagcatttgtccaantttttgtttgatttgatttttcatgtcaat

SEQ ID NO: 49986 - DNA, 101 bp, rice(Oryza sativa)
  misc_feature (71): n=t or c
gactagcgggtctctatagcaggaaaagtctgatacggttagctgtaacccatcctttacctgcaaattanaggtttggtcgctagcttttgccacagttt

SEQ ID NO: 49987 - DNA, 101 bp, rice(Oryza sativa)
  misc_feature (71): n=a or c
acagagatttccctgtccccgtcaatgagcctccttatctccctgactaggtgcgcagaggccgacaggtntttttctcttgattgcagcatctgtgtcag

SEQ ID NO: 49988 - DNA, 101 bp, rice(Oryza sativa)
  misc_feature (71): n=a or g
accaaatataataatgcctgtgccagaatttgcatcttacagatattatgtggccacagaatctagttcanctaatatgctagttcacctttgcaaggata

SEQ ID NO: 49989 - DNA, 101 bp, rice(Oryza sativa)
  misc_feature (71): n=a or c
cgacggatccacatacctcgagtctaccgtcattgtcgtggtcccacttagccgatgtttcgcccctcccnaccgtcgtcgtggtcaccctagcaaccatc

SEQ ID NO: 49990 - DNA, 101 bp, rice(Oryza sativa)
  misc_feature (71): n=t or g
cattggattgcagccgaatagctctactcctcccattgactggatcaaagcctgctcctctctgttcatanacatcaccagaatctcccccagccaaaaga

SEQ ID NO: 49991 - DNA, 101 bp, rice(Oryza sativa)
  misc_feature (71): n=t or c
ctcgagggagattccggtagaaggatccgcatatgcaaagaatgggtagagatttaccataaagtacgagncagtctgctgcaagaagtcgatcatggggc

SEQ ID NO: 49992 - DNA, 101 bp, rice(Oryza sativa)
  misc_feature (71): n=a or g
atcactacaccagcaaaatggactgcagcacaagcacgtatggataaaaccacaagagtaaaatacaccancggtccttaaacttgtcaggaggtttcact

SEQ ID NO: 49993 - DNA, 101 bp, rice(Oryza sativa)
  misc_feature (71): n=t or c
agaaatattaaatttcaatatcatactcaatcacagtcgaaagataccaaaaggttatatattactccctncgtttcgaaatgtttgacacagttgatttt

SEQ ID NO: 49994 - DNA, 101 bp, rice(Oryza sativa)
  misc_feature (71): n=t or c
gctatctaatccaacccctaactaaattaaattaaggattactagtacgatgcaccacacggtccagcccntagatttccgctgcgattaaactaatccat

SEQ ID NO: 49995 - DNA, 101 bp, rice(Oryza sativa)
  misc_feature (71): n=t or c
atttggcagaatgagttcatggcatggatgatcttggattatggggatataaattgagttttgggagtganagaaattggacaaactggatggatttgctg

SEQ ID NO: 49996 - DNA, 101 bp, rice(Oryza sativa)
  misc_feature (71): n=t or c
taattcggcgtgaggccattgttaatttagcattaggaagccagtttgcaaaccaattagcgaactcacanacgcggttaggtgaaaaaaaatatatttca

SEQ ID NO: 49997 - DNA, 101 bp, rice(Oryza sativa)
  misc_feature (71): n=t or c
agcctatgggccaaatgctagcccacaatactaaacaaaacaggtcaaaatgctaacccacagaacaaaangggccaaatggtagcccacagaacaaaacg

SEQ ID NO: 49998 - DNA, 101 bp, rice(Oryza sativa)
  misc_feature (71): n=a or g
ttatagtttaaatcactatcaccactattatgtttgtatagttttattacaaaattggttctccgaagaancaaaaacagattttgcgaaaaaatatatac

SEQ ID NO: 49999 - DNA, 101 bp, rice(Oryza sativa)
  misc_feature (71): n=a or g
aatttaagaagcgtgcgtgtgaaaaataaggtgatttaacataggagggagaaaaattaatgtgttcgccngttaaaaaagtctagctcataaggccagtc

SEQ ID NO: 50000 - DNA, 101 bp, rice(Oryza sativa)
  misc_feature (71): n=a or g
ttgccactataattcttttctttttttccaaccggttgtcaaggagggatgtgcattagagtatatgcccncccttaattacgcatcaactatacaaacat

SEQ ID NO: 50001 - DNA, 101 bp, rice(Oryza sativa)
  misc_feature (71): n=t or c
ctgagcgaaggtatacatccggtcagatacgtagctccgagtccgagtcatacaatgattcttgtctcagnagttaatggtaatggctattctcctgtttc

SEQ ID NO: 50002 - DNA, 101 bp, rice(Oryza sativa)
  misc_feature (71): n=t or c
tccgtgatgatgatgcagcggttggcgcgtcaagcggcacacgcggtcacccagcgtgccaggaatcaganggcggctacggctcgcggttaccaccacgc

SEQ ID NO: 50003 - DNA, 101 bp, rice(Oryza sativa)
  misc_feature (71): n=t or c
tggtccctcctctccgttcttgatttcttcccccatctcaacccagctgctgcagaaagcggcatttatcntgtggaattcggtgatatcttcttccgtcg

SEQ ID NO: 50004 - DNA, 101 bp, rice(Oryza sativa)
  misc_feature (71): n=a or g
taattaagtacgaaatctggaaaaaaaaattgagctctaacagcagactcaccctctacctgcggcgaacncaggacaaatttttggtgagtgctaataga

SEQ ID NO: 50005 - DNA, 101 bp, rice(Oryza sativa)
  misc_feature (71): n=t or c
gttggagcaaaacattatccaaacaattaagcattgaggtatctccaaaacacatctgatgattggcccanatatacacaggtggaagtaggtgctacatt

SEQ ID NO: 50006 - DNA, 101 bp, rice(Oryza sativa)
  misc_feature (71): n=t or g
gaactggtttgaaggtaaattttaataaatcttgtctcatcccaataaatattgatgaagggaaagctcanaagttagctgcagtttttggctgtcaattg

SEQ ID NO: 50007 - DNA, 101 bp, rice(Oryza sativa)
  misc_feature (71): n=a or g
caggccggcagctaagctagcaggcgttgtacagtatcatgcatggcttctgccctctggtgatcgagcanatcataagagcaacggcatgcagagcagcg

SEQ ID NO: 50008 - DNA, 101 bp, rice(Oryza sativa)
  misc_feature (71): n=a or g
gctagtagtactagtattgtgcacaaacgattgcatatcttcgtgaaaagaaaaggaacatttttcggggnaaaattatggtgcatcgttctcatttcacc

SEQ ID NO: 50009 - DNA, 101 bp, rice(Oryza sativa)
  misc_feature (71): n=t or c
tgtctaaattttttataaaattttacgtaacatttcctagttggtgcgcatggagtgtgtatgtaaagctngtatgcataggatatgttccctatataaac

SEQ ID NO: 50010 - DNA, 101 bp, rice(Oryza sativa)
  misc_feature (71): n=t or c
ataatctgctggttggtagccaacttcgagaatacggagaattttgtttttcagcttctgactacaactanagattgtcagaacctaggtaacaatatgaa

SEQ ID NO: 50011 - DNA, 101 bp, rice(Oryza sativa)
  misc_feature (71): n=a or g
tgtgtccaaacggacaaaattgtgggcaaatttcggttttctttatgcttggggcttggctcaatcctttncagtctttttatgtggacggcaaattggag

SEQ ID NO: 50012 - DNA, 101 bp, rice(Oryza sativa)
  misc_feature (71): n=t or c
gcacattggaagctccttttgaaatttcaggcctctgtggttgcttttgaagagggcgagaactggaggangagctccctttccttgtttgttcactgggt

SEQ ID NO: 50013 - DNA, 101 bp, rice(Oryza sativa)
  misc_feature (71): n=t or c
tgttccaaaccatctggacgacaccacttgtcaagttgtattgccacgatggcggctttgaacgattgcangtacgcgaacgcacaacgtcgactcgggct

SEQ ID NO: 50014 - DNA, 101 bp, rice(Oryza sativa)
  misc_feature (71): n=a or g
tgtgcatctcaaaggtgccggttgtggaaccaacaacagtgcatgatccggggtcattagtaccacctctnggatgctaattaggaaatccagcacctatg

SEQ ID NO: 50015 - DNA, 101 bp, rice(Oryza sativa)
  misc_feature (71): n=t or c
aggaatattcttacctgttaaagccaacatatacatgaccaaatgttccacggccaattagcttccccttnttccatcgtgacccaggacttggtggattc

SEQ ID NO: 50016 - DNA, 101 bp, rice(Oryza sativa)
  misc_feature (71): n=t or c
aaattctcgtataaagaggagaaacaaacgctcgatttttggatttgtagacgttttggtattttcctcgnattgcaagccacgggtaccaaactagtata

SEQ ID NO: 50017 - DNA, 101 bp, rice(Oryza sativa)
  misc_feature (71): n=t or c
tgatggctagtccaggtaaaagctagcaagattgtttcgttttctttcatctaaacagcacgcacacatcnatgcatagggatccatctgcacgtatcgtc

SEQ ID NO: 50018 - DNA, 101 bp, rice(Oryza sativa)
  misc_feature (71): n=a or c
tcggaaatttgcgcaaattaggcaaactgtcctttgctcgaaacagactctctggtcaaatcccagatganattgggaaacttgttcagctgaataatcta

SEQ ID NO: 50019 - DNA, 101 bp, rice(Oryza sativa)
  misc_feature (71): n=t or g
tctatcgaccacgccaccatcgtctcttacaccaactacaacaagcacatcatcaggaattttgagccgtnattgtgatcattgagatccaccgatttttt

SEQ ID NO: 50020 - DNA, 101 bp, rice(Oryza sativa)
  misc_feature (71): n=t or c
acggctcgttgcaggttgcgctttctactgtcaaatcctacagttagctagccaaaccgcaaacggagtgngacgcaacacgcactgatcagatcagtacg

SEQ ID NO: 50021 - DNA, 101 bp, rice(Oryza sativa)
  misc_feature (71): n=a or g
tcttattctccttccaccttggtacttcatttctttttaattaggttaacatcatgtcacctatcacctgntcatcagttttttaagagagatcaccgcat

SEQ ID NO: 50022 - DNA, 101 bp, rice(Oryza sativa)
  misc_feature (71): n=t or c
caactgtaagtatttgggatgaagctagctagccaacaggaaacagaaaagatgacaaccatgaaaaacanatctgtcttgtttctttggttcgtcatgga

SEQ ID NO: 50023 - DNA, 101 bp, rice(Oryza sativa)
  misc_feature (71): n=t or g
ttgcaagaatgtgtaaatttttgttctatgtaccttcaaggagttgaaacaagaatcaatcgaccaagtcnaatcgaggacgtgcagagtgacaacagcag

SEQ ID NO: 50024 - DNA, 101 bp, rice(Oryza sativa)
  misc_feature (71): n=a or g
acccaaatcaagaaaccgaagaagaaaaaaagaacaagaaaaggaattcgcgaggagctcggagaaacggnccgccggagaggagaggagaggagaggacg

SEQ ID NO: 50025 - DNA, 101 bp, rice(Oryza sativa)
  misc_feature (71): n=t or c
catggagctgatggctggaggagtacacaagaggaggaagatatccgatgagattgcagctgccgcaacancgccgcatccacaacaacaacgacgacagc

SEQ ID NO: 50026 - DNA, 101 bp, rice(Oryza sativa)
  misc_feature (71): n=a or g
agatgccagagcagtgcctctgataagggtgcgcggacctcctatagcattcgcacacccctgcagggacncggctccttccgacgtggcgcgaatattcg

SEQ ID NO: 50027 - DNA, 101 bp, rice(Oryza sativa)
  misc_feature (71): n=a or g
tcagttgagagaaaggaatgatccagatcaggttgtcctattgcttctgaattctgatggaccaggtggtntactgactgaattgcaacatcttatgcttg

SEQ ID NO: 50028 - DNA, 101 bp, rice(Oryza sativa)
  misc_feature (71): n=a or g
ggtcggacccatgtgtcggttagtgaagagggggtggaggagctgacgcggaggcacacgcgccctgtttnaaatttaagcggcggccgcgcgcggcgtgc

SEQ ID NO: 50029 - DNA, 101 bp, rice(Oryza sativa)
  misc_feature (71): n=a or g
taaacagcggaatgcgggacacatgtgaatctctgtgttcaggatgaggccacggcagaaacctccaaaanttcacggcgcaacgtggcgcaaatcccgag

SEQ ID NO: 50030 - DNA, 101 bp, rice(Oryza sativa)
  misc_feature (71): n=a or g
gatgcagcaacgccggcggggttctaatgctaaagcgattggtcctagtcgaggtcacctacctcgtgtcnttacttgtccgagggcagtgcccggagttg

SEQ ID NO: 50031 - DNA, 101 bp, rice(Oryza sativa)
  misc_feature (71): n=t or c
cttgattgttctattttgtttttggacttgaaatcccatttctgggattgtaaactttttcttttttcccnttaattaaattccggcagatcttctgccgt

SEQ ID NO: 50032 - DNA, 101 bp, rice(Oryza sativa)
  misc_feature (71): n=t or c
tgaaaacacactatgaatgtaatatctactgttgctctctaaaaccaaccgcgaatgctggaggagttaanagcaaagacaagaaaggataatcgagatcc

SEQ ID NO: 50033 - DNA, 101 bp, rice(Oryza sativa)
  misc_feature (71): n=a or g
gtaaatatgcacaagttacaaacaacccagagaatgatggctgtatcaatgctgtcttactcgtgtaaggncgcaatgctatacacttcattcttctcgtt

SEQ ID NO: 50034 - DNA, 101 bp, rice(Oryza sativa)
  misc_feature (71): n=t or c
agtatttttaattttttttcctcttctcttctctagagtactccaaaccactagcttaattaattaattgnactttattctatcaattaatcatcgtatgc

SEQ ID NO: 50035 - DNA, 101 bp, rice(Oryza sativa)
  misc_feature (71): n=t or c
cgtgccatcctaaggtcaggaatttccaaccctccgaaagctttgggatgacagacattcgtccaggacanctggcactactcctatgagccgagtctgaa

SEQ ID NO: 50036 - DNA, 101 bp, rice(Oryza sativa)
  misc_feature (71): n=t or c
ggggggttttagtgctgtgaggaagtatgttggtatagaggttagtaccgaagtgacaggggtcttccttnctgcctgttgcaacaacttccctttccaac

SEQ ID NO: 50037 - DNA, 101 bp, rice(Oryza sativa)
  misc_feature (71): n=t or c
taggtggactgctttagaccccgtctgcaaaactcggtttttatggtcggggtctaaagatgcctacctanaaagcgcggggagctattaaatctagcacc

SEQ ID NO: 50038 - DNA, 101 bp, rice(Oryza sativa)
  misc_feature (71): n=a or g
ccaagcttagccaattctatggatgtttgcatttcaaccacagcatgatttgggtcttcaccttcatgatnataggtgagagtaggggctctaaaatttca

SEQ ID NO: 50039 - DNA, 101 bp, rice(Oryza sativa)
  misc_feature (71): n=a or g
cacatgcaaaatttagacacttcttagataattcgttcgtgagcataatagcctttgcccacgatttcttnaaataaacacccacttaacacaaactaaac

SEQ ID NO: 50040 - DNA, 101 bp, rice(Oryza sativa)
  misc_feature (71): n=t or c
gctttctttgggacttgcaaaattgagttgtcatggactcgtagtgtttgttgatcattgctagtaaggcnctgtttagttgcctaaaactttttcccaaa

SEQ ID NO: 50041 - DNA, 101 bp, rice(Oryza sativa)
  misc_feature (71): n=t or c
gccgtcgcagttgccgctcaccgcgctgctggaatcgttgcagtagcacaggcagccggtgtacgagacgnggtcgtagtcgtcactgcccacgacaccgg

SEQ ID NO: 50042 - DNA, 101 bp, rice(Oryza sativa)
  misc_feature (71): n=a or g
tacattttatttatattacaccaaatttacctagattcagtggctgagccaagatcaagatccacctcgcncgaaatgcaaatattttttttactaatagt

SEQ ID NO: 50043 - DNA, 101 bp, rice(Oryza sativa)
  misc_feature (71): n=a or g
ccagcaattaatcgccattttttccgtgcgatttttttcccaaccccaaccacgatggtcgttaagtcacntgtggcgcagctgtgcttgcatgctgtgct

SEQ ID NO: 50044 - DNA, 101 bp, rice(Oryza sativa)
  misc_feature (71): n=t or c
aattttgcctcatcatatttatccttggccccttcatttctgttgtggtatgtatatcaatctctacaaanatactattaggtgtagcgtcacaaacatta

SEQ ID NO: 50045 - DNA, 101 bp, rice(Oryza sativa)
  misc_feature (71): n=t or c
aacaaaaagagagaaaaaaaaaccagaattctagaaaactcccgcaagttatttctgcccctcaaactttnatatttgtgactattggatcgccttgagat

SEQ ID NO: 50046 - DNA, 101 bp, rice(Oryza sativa)
  misc_feature (71): n=t or c
cctacacaaggttacccagtacaagaaaggaaaggatagcctttctgctcaggggaagcgtcgttatgacngcaagcagtcaggatatggtgggcagacaa

SEQ ID NO: 50047 - DNA, 101 bp, rice(Oryza sativa)
  misc_feature (71): n=a or g
atatatttacaaatatgggagtagcacaaatccctcctagggaatgagaggagttccgaagaaaagaaacntccaccgcggacaatctggtcgtttcaagc

SEQ ID NO: 50048 - DNA, 101 bp, rice(Oryza sativa)
  misc_feature (71): n=t or c
agatatattggcattatcattttgtcaaatacaaatataacaacaatttctatttgccatgggtctttttnttcttatgatatctaaatttaatcagttca

SEQ ID NO: 50049 - DNA, 101 bp, rice(Oryza sativa)
  misc_feature (71): n=a or g
ttcaggaatgccagggcttactgcctatggtggattctttgaagtggccaagccaaagaaaggtgaatatntcttcatctcatcagcattcggcgccgtag

SEQ ID NO: 50050 - DNA, 101 bp, rice(Oryza sativa)
  misc_feature (71): n=t or c
tgatctcccccttcgccccaaccttctcccgcagatctggcgatggcgacgacttctccgttggatctaanggcggcggcggcgacccgcggacggatccg

SEQ ID NO: 50051 - DNA, 101 bp, rice(Oryza sativa)
  misc_feature (71): n=a or g
caccacatcaatctccccaccaatcgtcgcagccctcgctccagatctcttcattccttttgcatccatgncggaagagagagaaagcttcgagagtcaat

SEQ ID NO: 50052 - DNA, 101 bp, rice(Oryza sativa)
  misc_feature (71): n=t or c
aaaatcaaggggggatgggtggaattttctaaacctagctacatgaaccttcctcgtcatcctctgtcgtncgtgcactcaatagacgatcgagatggccc

SEQ ID NO: 50053 - DNA, 101 bp, rice(Oryza sativa)
  misc_feature (71): n=a or g
caaactattatatattagagttttcgttcggtttacctccgattcaagcctaaaaaaccaaatcgatttcngttttcacctatgttatctatagcgttaat

SEQ ID NO: 50054 - DNA, 101 bp, rice(Oryza sativa)
  misc_feature (71): n=t or g
taaaatactatgactaatcacagcacagacaacgtgctactaccccactaatgatagtctaatagatttcntcagcagatgcagcgaccggactagttgat

SEQ ID NO: 50055 - DNA, 101 bp, rice(Oryza sativa)
  misc_feature (71): n=t or c
catctctttacattaagttcaacaatgtattgagatcctctatcgctaacctgaaatactcccatcccagnaggcaaaacatagcatgtattagccatctc

SEQ ID NO: 50056 - DNA, 101 bp, rice(Oryza sativa)
  misc_feature (71): n=a or c
tgcaaccgctatggtgcagagggactccagcaggaccgtcacgactcgtcccaaagtcgtcggactcgtcngcactcagcgggcccttgttcagattttca

SEQ ID NO: 50057 - DNA, 101 bp, rice(Oryza sativa)
  misc_feature (71): n=t or c
gagctattgcgtcgccacgagtgagtggcaccagtcacgcgctgttgagcttgtcgtcgcctcgccaccanctcggcctcctcgatcaccgctgcgtcccc

SEQ ID NO: 50058 - DNA, 101 bp, rice(Oryza sativa)
  misc_feature (71): n=t or g
tgtatagttgtatatatgcatgtgatcgatgggagagagatgcatggagaagtggtaatgaagctccttgngtcttgtatatttatcaatgtttggtttgg

SEQ ID NO: 50059 - DNA, 101 bp, rice(Oryza sativa)
  misc_feature (71): n=a or g
taaaacgtcaagaaaggcgataaccactagcactacaacacactactggtcctcatttcacaccaaacgcntccaaactcttgtgtgctatctacgtgctg

SEQ ID NO: 50060 - DNA, 101 bp, rice(Oryza sativa)
  misc_feature (71): n=a or g
atgaccaaaattgtcgatggagactttgggtacaacttattacctgcacactcaactaactagataaaggncatgttcggtagcccgttttcacagctgtt

SEQ ID NO: 50061 - DNA, 101 bp, rice(Oryza sativa)
  misc_feature (71): n=a or g
gtagattcctccacccttcccaccttagatagtccaaatataagagaattgtagcagtacaaatcagggantacattcacctttgtcatcttatcaaaaat

SEQ ID NO: 50062 - DNA, 101 bp, rice(Oryza sativa)
  misc_feature (71): n=a or g
aagaggagccgagatggtggtcttggacgctatctagactgcacacaagcttatgagcccatcctccacancaagcatgctatggccatcgaccttgaggc

SEQ ID NO: 50063 - DNA, 101 bp, rice(Oryza sativa)
  misc_feature (71): n=t or c
acccactccaatctatccaatcccctcaatgccgcactcatcactccataatccacctttggctctgagcnagccggaaacagaagaaccgcgcaatcggg

SEQ ID NO: 50064 - DNA, 101 bp, rice(Oryza sativa)
  misc_feature (71): n=t or c
tgctcatcttaatctctctcgaaacaaatgcacaatcaccttaatgatgataatcccaataacaccgtgcncgatccaggcatctttccatgtgaccccac

SEQ ID NO: 50065 - DNA, 101 bp, rice(Oryza sativa)
  misc_feature (71): n=t or c
gggaccatacttcttacaaccatcttttaaattcagtagtccgcaccataaaaatactacaaactagttgntccttctcacagaagcagactgctatcact

SEQ ID NO: 50066 - DNA, 101 bp, rice(Oryza sativa)
  misc_feature (71): n=a or c
ctcaccagtcaccacctaggagtatttgcagagtagtaggagtaggaccgtatcgtatagcgatgaggacncttcttcaagtgctgtttagttcctcatgg

SEQ ID NO: 50067 - DNA, 101 bp, rice(Oryza sativa)
  misc_feature (71): n=a or g
gctggttgcccccatactctgcacgcacgaggatatataatgacaaacccaaaaacagaaagcaaagttgntggcgccatcaaacatcacacaggctgcac

SEQ ID NO: 50068 - DNA, 101 bp, rice(Oryza sativa)
  misc_feature (71): n=a or g
tctctttctctgtcttcttcgcaggacactggtccatttcctccagtttcatttctagtctctaccatctnatctcctcttgcagctcgtcagttcgatac

SEQ ID NO: 50069 - DNA, 101 bp, rice(Oryza sativa)
  misc_feature (71): n=a or g
attgcacaaattcgggactagatacgctacaacccactaacttaggtagggatgtgatcccttctagtacnatgaatctggatatccatatatcaaaattc

SEQ ID NO: 50070 - DNA, 101 bp, rice(Oryza sativa)
  misc_feature (71): n=t or c
agcggcatgaagagcaaaaacaagaatcgggggacggcctgtacgggcacactgagtaagtaaatcgtttnccagtacatatataaatatttgactagatt

SEQ ID NO: 50071 - DNA, 101 bp, rice(Oryza sativa)
  misc_feature (71): n=a or c
aataatttgtagctacgagtagtagtattatatctcacgtgctgacctaatagacaatccatcaggagagngagctaggccccacggctcagtgtcttacg

SEQ ID NO: 50072 - DNA, 101 bp, rice(Oryza sativa)
  misc_feature (71): n=a or g
tctttgatacgccattacttcatcccaatcttgtaggctccctaacccttccgatacgtatgccataaagncttttcttgcagaaactgttcaagcgccat

SEQ ID NO: 50073 - DNA, 101 bp, rice(Oryza sativa)
  misc_feature (71): n=t or c
tggtggtagatttgtcaccgaccaacactatactccctttttaattaaggtatatctaatatgtactttcnccattctaaaatataataactactactgtt

SEQ ID NO: 50074 - DNA, 101 bp, rice(Oryza sativa)
  misc_feature (71): n=a or g
tgcccagtagctcttcttgactagagaacagttttgttaaccaggagggaacccatgaataggtttttacnttgcaatctccatgttttaatcagttctat

SEQ ID NO: 50075 - DNA, 101 bp, rice(Oryza sativa)
  misc_feature (71): n=t or c
acttttttttatgactatttagataacatgctagtaatacggtgcatgcactataagttgcagattgactntccctttccacatacatatatatgtcctaa

SEQ ID NO: 50076 - DNA, 101 bp, rice(Oryza sativa)
  misc_feature (71): n=a or g
aaacacatttagttaggacgtagtcatgttaccgagaataaataatatacacttgaacttacctctgggcntaacagtaccgtgcgaagcaacagctgtag

SEQ ID NO: 50077 - DNA, 101 bp, rice(Oryza sativa)
  misc_feature (71): n=a or g
tcacaaaataataatcaaaggtcatcttcgcaaatggtgatggatgcacactccgctttcatgagagaganagagagagagagagagagagagagagagag

SEQ ID NO: 50078 - DNA, 101 bp, rice(Oryza sativa)
  misc_feature (71): n=t or g
tttagttgaaagtggctaatacaaggtcttaaaatagtccttggttgaacatggattagtgatggttggcngttgctatgtttttttttaaaatacacaag

SEQ ID NO: 50079 - DNA, 101 bp, rice(Oryza sativa)
  misc_feature (71): n=t or c
gaccaaatagattgcaaaagtgtactcctagctgagagacgctcgatagaaatgtgtcatatagcagtagnggccaagttgcagtgttggtttatttgaat

SEQ ID NO: 50080 - DNA, 101 bp, rice(Oryza sativa)
  misc_feature (71): n=a or g
attttcttcacttcagagaatgaagtgaattactgattccttgcaggttaccagatattctttctatggcntgaaggagtcatttggatttacaccttcct

SEQ ID NO: 50081 - DNA, 101 bp, rice(Oryza sativa)
  misc_feature (71): n=t or g
actaatgcaaggtttaaaagaggagttgggccaaggcatagtgttacaagcttcctaaaggaatatgacanaataaatgacactatatttgatacactgta

SEQ ID NO: 50082 - DNA, 101 bp, rice(Oryza sativa)
  misc_feature (71): n=t or c
cagttagctccattttcaggtctcttgtttcgttcaaacaaaaatctgtacgcgttaattaataaggccangtttctttcagtttgggtttattataatct

SEQ ID NO: 50083 - DNA, 101 bp, rice(Oryza sativa)
  misc_feature (71): n=t or c
acaatggatttacgaacatctagatgaatattgcatcaattcttctgagattgatggtgagaccacagagnttgtaagaaagatggtagtggttgcactgt

SEQ ID NO: 50084 - DNA, 101 bp, rice(Oryza sativa)
  misc_feature (71): n=t or c
gctccatgttcaggatcagcgtcgtcggcatgactgtggcgaactgcctgtaggattacgcagggaaaatnaattgcttcaaatgggatgagtcatagtcc

SEQ ID NO: 50085 - DNA, 101 bp, rice(Oryza sativa)
  misc_feature (71): n=a or g
tagaaaaaaatatcccttcttatattagagtacgtacaagttgttactgttgaatacaagtcttttgtggncataggggtgggcattcagtctgaccaaaa

SEQ ID NO: 50086 - DNA, 101 bp, rice(Oryza sativa)
  misc_feature (71): n=a or g
gggcatccacagcctccaatgagaaagccactgcaattatgctttggctttcattgcgagagatacagatngatgattttgtggataagtgcttctttgtt

SEQ ID NO: 50087 - DNA, 101 bp, rice(Oryza sativa)
  misc_feature (71): n=a or g
atccaccacatgttttgatggttcattcatgctcggtgcatgtaaagtttagtgtttggatccttgcattntataggtataggcgtatagcgttggctgat

SEQ ID NO: 50088 - DNA, 101 bp, rice(Oryza sativa)
  misc_feature (71): n=t or c
ggattgacctaaaccattccacatgaccactctggcccatggtttagtagggggcaacccttgatggtttnattaaataaatggttatccaatggagcaaa

SEQ ID NO: 50089 - DNA, 101 bp, rice(Oryza sativa)
  misc_feature (71): n=a or c
tatactggttcaggctccttgtcaggtaatagcctagtccactttatatgcgattgatgatgaggaaccanagattacaagaaaagtagacaaaacagatg

SEQ ID NO: 50090 - DNA, 101 bp, rice(Oryza sativa)
  misc_feature (71): n=t or c
cccttccccggatcgctaagaaattaatggcagatgtgctggaattgaaggccatgttgaaggcaagtaangcagcaaagaaggtggtagatgggtgtacc

SEQ ID NO: 50091 - DNA, 101 bp, rice(Oryza sativa)
  misc_feature (71): n=a or g
aagccaaatgctcctgtatcttggcactgttatttcactgggcttagttgctgaaacatgaaggagtacangggcctcttatagaccggggacacaccagg

SEQ ID NO: 50092 - DNA, 101 bp, rice(Oryza sativa)
  misc_feature (71): n=t or c
gggtaccagaacccttgccaaacatacgatacctactatgcagcactagtaagctgttcaacagaatttgncctagctagtgtccctggcactgccaccga

SEQ ID NO: 50093 - DNA, 101 bp, rice(Oryza sativa)
  misc_feature (71): n=a or c
cctgaccatggccattgctagcgctgtaaagcaaaaggtgcatcacgaagaaggaagaactccaagtgtcnagaagttcaatcgatgccacccttctaaac

SEQ ID NO: 50094 - DNA, 101 bp, rice(Oryza sativa)
  misc_feature (71): n=t or g
tcgccatggattctagatccaacaacttaggcttggatagttgaattgatctgattgatttggggttgggnttgggcggcgagctcggcggccggcgcggg

SEQ ID NO: 50095 - DNA, 101 bp, rice(Oryza sativa)
  misc_feature (71): n=a or g
tgaagtgttttatggttcagagattgcgtcattcaaagatgccctcgcagcaatcggagtagtcatcaatnttgaaaatggatgtgatcttgttgcccagc

SEQ ID NO: 50096 - DNA, 101 bp, rice(Oryza sativa)
  misc_feature (71): n=t or c
cctcaacctgctgcacttcttgcattgctcaatcagatatagagccaataacaacacgctgtcgtcttganatttatacctacactcttcttgggtgcaca

SEQ ID NO: 50097 - DNA, 101 bp, rice(Oryza sativa)
  misc_feature (71): n=t or c
aagcacaaacgtgagcctcggacagtagtgtaagtgtatactcctcagttttgcaaaggaactatcgtccngaggactggctgtccttcctctgctccaaa

SEQ ID NO: 50098 - DNA, 101 bp, rice(Oryza sativa)
  misc_feature (71): n=t or c
atacataagtaccatgctgatgtcatcatggtatcttcggtataagacatgataccctgtaagttttatgnaaacgtcattatgacattgcctattccatt

SEQ ID NO: 50099 - DNA, 101 bp, rice(Oryza sativa)
  misc_feature (71): n=t or c
cccttgtcctgggatcacctggatgctgctgctagagggacattcttctcaagtacagtcagatgccaacngattgagaagatgctctcaaatatggggtg

SEQ ID NO: 50100 - DNA, 101 bp, rice(Oryza sativa)
  misc_feature (71): n=t or c
ttgagagccgtcgtaagtccacatggacgagtagttttgaattggtcctcctgagctatgtaaatgtgggntggtgttcctcaaactttgctgccaggtga

SEQ ID NO: 50101 - DNA, 101 bp, rice(Oryza sativa)
  misc_feature (71): n=t or c
atgggagggctgggaattctcgaaatggaaaaattcacatctacgcttaggctacgatggttgtggctgtntgatacaagcagaccttgggagctgatgga

SEQ ID NO: 50102 - DNA, 101 bp, rice(Oryza sativa)
  misc_feature (71): n=a or g
attacattgtttatccatacaagataaatcagattgattacgctgatgcatgctagccatgtgatccaatnaatttaactgtaaatagagatcacacatcc

SEQ ID NO: 50103 - DNA, 101 bp, rice(Oryza sativa)
  misc_feature (71): n=t or c
aggccaacttctccatcgacgccgacgccacgacgatgcccacaccaaattccgacaaccagccatctacnagaagagcggagtgttggcggcacttcgaa

SEQ ID NO: 50104 - DNA, 101 bp, rice(Oryza sativa)
  misc_feature (71): n=a or g
acgagagtacacgtacgtacgacaccgtgtgcgtgtgtccgttgcgtgatgcggatcgatcgagcggagcngcggcggccgtatcgatcgatctcgcttcg

SEQ ID NO: 50105 - DNA, 101 bp, rice(Oryza sativa)
  misc_feature (71): n=a or g
taaacttacttaaaaaagaaaaataatgcggtgacaaaaaagaaaccatgtgggaagtaggggtgaaaacngatcggataatatccgattcgatccgatcc

SEQ ID NO: 50106 - DNA, 101 bp, rice(Oryza sativa)
  misc_feature (71): n=t or c
catcattagctattacttcctccgtttcacaatgtaagtagcatttcccatatataagtagcatttcccanatatgaatgtggaaaatgctagaatgactt

SEQ ID NO: 50107 - DNA, 101 bp, rice(Oryza sativa)
  misc_feature (71): n=a or g
tagaagttgtatatatattttgggatggaaggagcataagaaaaggggatattagagatgagagatggcgnaaaaaaaacaaaattgggtcaaagcaaaaa

SEQ ID NO: 50108 - DNA, 101 bp, rice(Oryza sativa)
  misc_feature (71): n=t or c
caatagcaggccggggcctcccttgatgtgtttctttaagaaagaatatgtataaaaatcgaccctagaanccaaactattcatgttctcgattgccttga

SEQ ID NO: 50109 - DNA, 101 bp, rice(Oryza sativa)
  misc_feature (71): n=a or g
atataattaatatccatttcctaattaatatccgaaagggattcggcatcggggcttctagccaccagagnagatgttaattaagaggagaagaagcacct

SEQ ID NO: 50110 - DNA, 101 bp, rice(Oryza sativa)
  misc_feature (71): n=t or c
gaataaagacacgaggtgacccggttctcgcttacattgatagcggcagccttctcgactgccgacttgtngcagagcggggctggtggctcgtcagccgt

SEQ ID NO: 50111 - DNA, 101 bp, rice(Oryza sativa)
  misc_feature (71): n=a or g
cgctggaccgggttgcgggtcgcttctgccgcgcggtatccaggttcttggcgatctccgacgcaaccagntggttgaagctcatgttagaatttttcaaa

SEQ ID NO: 50112 - DNA, 101 bp, rice(Oryza sativa)
  misc_feature (71): n=a or c
atttcgtaaaaagaaaaaatccggaaccaacgtgcaaacgtacgtaatagttctggatcatactaaggaantgttgacgaccaaatttggtaagatgtgaa

SEQ ID NO: 50113 - DNA, 101 bp, rice(Oryza sativa)
  misc_feature (71): n=a or g
actggctagctatatatacacatacgcgcgcaaatcattaagttcaggacagatactaacaataacagagngagagagagagagagagagagagagagaga

SEQ ID NO: 50114 - DNA, 101 bp, rice(Oryza sativa)
  misc_feature (71): n=a or g
cttacggttattctccttgttgaggtccacatttctcttctgctttttgtgaccctcaccatccttttatntgcacttactgtcggggtgatccatctgtc

SEQ ID NO: 50115 - DNA, 101 bp, rice(Oryza sativa)
  misc_feature (71): n=t or c
cggtagttggctgccacaaagttaattgttgagactctttacactttcatttatacaatccgtgcttatgnagataagctaaactaaagcgattcctaata

SEQ ID NO: 50116 - DNA, 101 bp, rice(Oryza sativa)
  misc_feature (71): n=t or c
tgagttggatgggaatatggaatgattcctgagtattttgtaccaccgctccaggcaaaattcacaagtgncgcaatgttcaagcaaaattcatgttctat

SEQ ID NO: 50117 - DNA, 101 bp, rice(Oryza sativa)
  misc_feature (71): n=a or g
gtgctgcatcttttgtttgcagtatgcacaccttgcatattgcaaacggttacttccttcgtcttaaaatntagctacaaaataggacattatctagtact

SEQ ID NO: 50118 - DNA, 101 bp, rice(Oryza sativa)
  misc_feature (71): n=t or c
ccgaagatcaccagagtcgccgaagatcgcatctacctagtgctacactgctacgacgtcgccaagacgtngggtgtccttactttgctggtcgcaaccta

SEQ ID NO: 50119 - DNA, 101 bp, rice(Oryza sativa)
  misc_feature (71): n=t or c
gcatcagcgcactaaacatgtggagattgatctacatttcgttcgcgacaaggttgctgttggtgctattngtgtgctgcatgttcctacttcctcccagt

SEQ ID NO: 50120 - DNA, 101 bp, rice(Oryza sativa)
  misc_feature (71): n=a or g
cgccgctattacaagaggaagatggccgagcagcatcgcaaggaagaagaggctgcaaaccggcaaagcancagcagccaccaccctagcctcgcagcaac

SEQ ID NO: 50121 - DNA, 101 bp, rice(Oryza sativa)
  misc_feature (71): n=a or g
aaatgcaattaacctgaggggcactgagactagaatcaccacaatcatcaccaatgttggcccgcttttcntctagtgattccggaaaaacataaaaacga

SEQ ID NO: 50122 - DNA, 101 bp, rice(Oryza sativa)
  misc_feature (71): n=t or c
agggagaatgaatggttacgatttaaagcggcgcatcgagcttgtcaacgacggaccgacctcggagttgnggatgaagctcccgtaccaaacgatggcgc

SEQ ID NO: 50123 - DNA, 101 bp, rice(Oryza sativa)
  misc_feature (71): n=a or c
catgtccatttccctagtgcctccaattcctataagcagaggtaaaccatatatatggcctctcctctctntttctttgtgcacgcgtagcctcttactct

SEQ ID NO: 50124 - DNA, 101 bp, rice(Oryza sativa)
  misc_feature (71): n=a or g
aaagcactataaatgttggctttagttgttccggcctacacatatagtgcccacctatatgtgcctttctntagtagtgtattttgtgcctacaagtatgt

SEQ ID NO: 50125 - DNA, 101 bp, rice(Oryza sativa)
  misc_feature (71): n=t or c
ttgtctccctcgactataggtccaatctgattcgttctcccttaatcgcaaaccgtgtatatcgaaccctnggctattaacaccggtgaataaaaaaactc

SEQ ID NO: 50126 - DNA, 101 bp, rice(Oryza sativa)
  misc_feature (71): n=t or g
tgctttccacaaatgcatttggtattcagaaaggtagagaaaaaaaaacaacattctcaatttgtttccanttcttgagatctgacataaaaaaatttgct

SEQ ID NO: 50127 - DNA, 101 bp, rice(Oryza sativa)
  misc_feature (71): n=a or g
accgcttcttttctccttagtcattgcacggatggtctcgatccaccagtcctcgagggatgttgtgtgtntccagttttgtagccgcagctgagggatcc

SEQ ID NO: 50128 - DNA, 101 bp, rice(Oryza sativa)
  misc_feature (71): n=a or c
atcttctcaacttctgcgccgttgttaacgacgaaattcggtaaatcatttatcggatttagtgttaaggncgaagcggatttgggaggaaatcgataaca

SEQ ID NO: 50129 - DNA, 101 bp, rice(Oryza sativa)
  misc_feature (71): n=a or c
atccatttcacttcacccaggactttggatacatgaaacatctgtgcaagcccaggaacaacacaagcacnaaatcttctgcagccttgcaaacagtgcag

SEQ ID NO: 50130 - DNA, 101 bp, rice(Oryza sativa)
  misc_feature (71): n=a or g
ggacgatgcatctcagtatcacacatcttagcacctattgacagtgcagattgtaggtgcaggcgaacccnagctcaaatctgtattttcctctctctcta

SEQ ID NO: 50131 - DNA, 101 bp, rice(Oryza sativa)
  misc_feature (71): n=t or c
gcacccgttccccactttcgctcttcctccaatttctctgcggcatccgcccccaatcacagaaccacttnaccttccctctcctgctcacctctatgttc

SEQ ID NO: 50132 - DNA, 101 bp, rice(Oryza sativa)
  misc_feature (71): n=t or c
ataatctattgttttaatgtagctgcagtgacttgtgaaaaccttagctgattaagttttatgataataanaagaatctgtcttcttgtcttattaaatgt

SEQ ID NO: 50133 - DNA, 101 bp, rice(Oryza sativa)
  misc_feature (71): n=a or g
cgcgtttctcctctccttaccccgctccttctgcgcacgggaaataaaaaaactagaatttctgttggtantttaacagaagggcccacttttagtttttg

SEQ ID NO: 50134 - DNA, 101 bp, rice(Oryza sativa)
  misc_feature (71): n=t or c
tacacaattatctgcataatactagtgttagctcaccagccgatctcattagagatgagagtgacaaatcnttaattgacacttataagagtggcaattag

SEQ ID NO: 50135 - DNA, 101 bp, rice(Oryza sativa)
  misc_feature (71): n=t or g
gtggggccaagtcgaactgggcccgtaggacagataaagcaaggttagaaacataggtacacaatgaaatnagtgaattttcaagaattttctctctctcc

SEQ ID NO: 50136 - DNA, 101 bp, rice(Oryza sativa)
  misc_feature (71): n=t or c
cacgatacctctgtcggcaaaccacattgcaagtttgagcccacttcacaagatggaaattattatttttnggtactactcttttgaaattatgaggaaaa

SEQ ID NO: 50137 - DNA, 101 bp, rice(Oryza sativa)
  misc_feature (71): n=t or c
ttgtctaggcccaccattaatgttgggtgaggttgggttggacaggaacatccccatccccgcttgcttgnggattcacatggccccagccagaggggaga

SEQ ID NO: 50138 - DNA, 101 bp, rice(Oryza sativa)
  misc_feature (71): n=t or c
acttactaccctttgatttggaggaaacataggaattttaaagaatttcatagaactattattgggagcgntgcgcgctcctatattccaagcgccaaacg

SEQ ID NO: 50139 - DNA, 101 bp, rice(Oryza sativa)
  misc_feature (71): n=a or g
gacttttaataatctctattatttctttcgggaagtgatttttaacttggcatgaatttattaggacatgncactgataaagatgagggttccggcccatt

SEQ ID NO: 50140 - DNA, 101 bp, rice(Oryza sativa)
  misc_feature (71): n=a or g
tttttccaaattaaaacgctctcggctttcccagttttgtgagagaatgcattgggctttgtttccacgangaaaaagtacaccaaaggtccctgaacttg

SEQ ID NO: 50141 - DNA, 101 bp, rice(Oryza sativa)
  misc_feature (71): n=t or g
ggagagccagtctgatcacggagtcggattgcttgcgtgactgaagccgagtttagtccaactttttcttnaaactttaaactttttcatcacattaaaac

SEQ ID NO: 50142 - DNA, 101 bp, rice(Oryza sativa)
  misc_feature (71): n=t or g
agtacgccccctccggcctggacacgagatcagagtggctgccgtgctcgacgatccggccatcctgcacnacggcgatgcggtccacgcctcggatcgtc

SEQ ID NO: 50143 - DNA, 101 bp, rice(Oryza sativa)
  misc_feature (71): n=a or g
cgtaaaccgatactataataaactgctactagttgcgagtatttctgataatttctagctggcaatgtgcngtatgccggtatatactactggagcaactt

SEQ ID NO: 50144 - DNA, 101 bp, rice(Oryza sativa)
  misc_feature (71): n=a or g
tccctctgcgcatcaaacaacgaaccatcccgaggaagaaggaacaaaaaagattagcaaaaaaacggagnaaattaggggcaaaacggaaacaacaaaaa

SEQ ID NO: 50145 - DNA, 101 bp, rice(Oryza sativa)
  misc_feature (71): n=a or g
ttcgaccacagtctcgtcaccaccatctcccttacacgcaccattttcttcatgatcaccaccatctcacntctttatctattataaaaattaaagatatt

SEQ ID NO: 50146 - DNA, 101 bp, rice(Oryza sativa)
  misc_feature (71): n=a or g
atgctgtttaaacttaaactaaaattgagattgctccgcaggttcatacaggcttcccagtttagattagntggatgctagttctatgtacaggactcttt

SEQ ID NO: 50147 - DNA, 101 bp, rice(Oryza sativa)
  misc_feature (71): n=a or c
gtagtttcgtccatatccaatccagtctcatggatgtgtttataagggtatgttattcgtgcgtgcattcnttgaaactatatcgttcataaaagttaggg

SEQ ID NO: 50148 - DNA, 101 bp, rice(Oryza sativa)
  misc_feature (71): n=t or c
gagtccaactacagtctttaaaaaccattttccaagagaggcttggtcgtcttgaatacaccgtatcgctnagcattgctgagaggcaacttgaaggaatc

SEQ ID NO: 50149 - DNA, 101 bp, rice(Oryza sativa)
  misc_feature (71): n=t or c
tttcactgttgggcttgtttttatcagctgattccacttgacgctttccttgggaactcacaagtggtggnctatctaattgatcaagatgactgtcctgt

SEQ ID NO: 50150 - DNA, 101 bp, rice(Oryza sativa)
  misc_feature (71): n=a or g
ttttttaagatagagtagtagttagaagaggtggacttagaatacgaaaatgagtgaagggttaagatggnacagtatatatttacaatggcagtgaaacg

SEQ ID NO: 50151 - DNA, 101 bp, rice(Oryza sativa)
  misc_feature (71): n=a or g
ctccgacattggcacgatcttggatggctcctgaccagggcatggctcgttgttggcgctgtggagctgancgatgcagtcggagctgtcaaggtcggcgt

SEQ ID NO: 50152 - DNA, 101 bp, rice(Oryza sativa)
  misc_feature (71): n=a or g
ttttgcccactgcgctttcggtttcggacggacgtgtccacatgaataccccggacacatgggtaaaattnccatccctacatacatacatacatacatat

SEQ ID NO: 50153 - DNA, 101 bp, rice(Oryza sativa)
  misc_feature (71): n=t or c
tgaagagcctgaagcaaaagaaacaaggtatacatgaggtgatctcgatgtcaccttgcaaggaggcaatnaagaaactgcatatatttctctgcagttta

SEQ ID NO: 50154 - DNA, 101 bp, rice(Oryza sativa)
  misc_feature (71): n=a or g
agcaacacgagcaattcacacacacatgacccgggacgaagaggttctccacgcgacgagcaagcatttgncggtgggtcaccgacttggaccgcgtcgac

SEQ ID NO: 50155 - DNA, 101 bp, rice(Oryza sativa)
  misc_feature (71): n=t or c
tcatgactttgcacaaatttcatgatttttcacccatcatcatagtgcattgtcaattttgttgtccttcnatgaaaaggatttggaattgaattccttgt

SEQ ID NO: 50156 - DNA, 101 bp, rice(Oryza sativa)
  misc_feature (71): n=a or g
acaattatactccttgaccaattaactaacttgacgccagcttagagctctccctgatacttccctttttnatctgtttcacatgtttgttcattgtctga

SEQ ID NO: 50157 - DNA, 101 bp, rice(Oryza sativa)
  misc_feature (71): n=a or g
aataagaggagtgaggatctactgggcaacgacgacagtgttgtcggatctagcggacaacaaaggcactngcggatctaacagggaacaacgacactgat

SEQ ID NO: 50158 - DNA, 101 bp, rice(Oryza sativa)
  misc_feature (71): n=a or c
gtgcttgcaaaaccgcgtgacgaatatgtgaatagagaaactctcacagcagttttatctctaagtgtgangatatcacgcaacttaatgaatgcccgaga

SEQ ID NO: 50159 - DNA, 101 bp, rice(Oryza sativa)
  misc_feature (71): n=a or c
gcagttttgttgtccacgcttttgaaaaccttgatgtacaaatgtacccataacaagtcatctgtgtctcntcttgtctgtcccaaaaataacatcatttt

SEQ ID NO: 50160 - DNA, 101 bp, rice(Oryza sativa)
  misc_feature (71): n=a or g
ggaccagaaccggagcaggaccagatagatgggacggagcaggaccacgtggatgggacggcgactgacancccagacgccagcgccggccattctcctgc

SEQ ID NO: 50161 - DNA, 101 bp, rice(Oryza sativa)
  misc_feature (71): n=t or c
aaacgtgttataacatggaacgacgggagtatatgtgtgtgcgcacatgcgcatgtgtatatttgttgaantggtttgtgggcagcgggaaatgctcctga

SEQ ID NO: 50162 - DNA, 101 bp, rice(Oryza sativa)
  misc_feature (71): n=t or g
cgtgatcaccgttccggatgggaacttgttatagcaaccacagcctaatataaaatagtgagataccaatngaaaggaggagacggatttttccctttcgg

SEQ ID NO: 50163 - DNA, 101 bp, rice(Oryza sativa)
  misc_feature (71): n=a or g
ccctgttctgttgacttatgaatttcgttcatgcagatcgtccaaagctgtccatcgatacagccatactngtaaatatgaccgcaaaaagagattcagca

SEQ ID NO: 50164 - DNA, 101 bp, rice(Oryza sativa)
  misc_feature (71): n=t or c
ttcacatgtcttagctgtcaccgtcttgtactgtcgctgtaactagttgatgctgcccttctgccatcttngcaagtgaagccggcgtcaccgcgcgtaga

SEQ ID NO: 50165 - DNA, 101 bp, rice(Oryza sativa)
  misc_feature (71): n=a or g
cgtggtcgtcctcgcttccgagaccgcaaccgacgacatcttcccgccaccaccgtcgcacttctcttccncccatcctctggcttctccccttcctcacc

SEQ ID NO: 50166 - DNA, 101 bp, rice(Oryza sativa)
  misc_feature (71): n=a or c
caggcccggtggagctcgtcagggagccgtatgacggcatcagcctgccgcggctgcggtggaacccaaantcgtggaccaaggtggctagcatcctcttc

SEQ ID NO: 50167 - DNA, 101 bp, rice(Oryza sativa)
  misc_feature (71): n=t or c
tggtttgtattggtggagatttagcagtcaagggggagtggagaggggcgacgactctgctggtaggcccnggcccgcatgtttaggagtgacaaatgaca

SEQ ID NO: 50168 - DNA, 101 bp, rice(Oryza sativa)
  misc_feature (71): n=a or c
acagcttcggcttgaaatggccgcggcggcgggagctattccgccggtttatatccttcttctcctcctcnggaggaggaggatgaggagggtggcggagg

SEQ ID NO: 50169 - DNA, 101 bp, rice(Oryza sativa)
  misc_feature (71): n=t or c
aagtccactttgactcccttaaatgtgaccccaatctaatatatgtgaccttaaccgcaaaaccaaatatnatggcccctcagctgttaaaaccggtgtaa

SEQ ID NO: 50170 - DNA, 101 bp, rice(Oryza sativa)
  misc_feature (71): n=t or c
atttggaattatgctaatctccatatcgaccataattaacatgagtccaaactctgggcctgttcctgatngcaagctctataaacaacaaaacgtaggac

SEQ ID NO: 50171 - DNA, 101 bp, rice(Oryza sativa)
  misc_feature (71): n=t or c
acacagttgctgcagattctaaaacacaaaaacggaagggaaacatgaggcttaggtagggagttgcatanagtgattgccacggctactgtcagtttgtc

SEQ ID NO: 50172 - DNA, 101 bp, rice(Oryza sativa)
  misc_feature (71): n=t or c
tctcagtggctggcagatggataactattgcttcaacagttaattaatgcagagagaacatgagtcatgantgacactagctcccagtctcatcacatgca

SEQ ID NO: 50173 - DNA, 101 bp, rice(Oryza sativa)
  misc_feature (71): n=t or c
gcccggcccgcgacacatgcatgcagtcagccacggtcacacacacacctgatcgacctgccgcctgccgnctgcccgtctgccgcgcgctgcttctctct

SEQ ID NO: 50174 - DNA, 101 bp, rice(Oryza sativa)
  misc_feature (71): n=t or c
atttataggagagacattgtattctccataacccttgtaagccgcataaacaacgcgacatgcaaaacaanacactatttcatcattttacgttgttaaat

SEQ ID NO: 50175 - DNA, 101 bp, rice(Oryza sativa)
  misc_feature (71): n=t or c
ttaaaacggatgaaatagttagcagcggggagggaatgctatagaaactatcatgtataagaatctgtccnatggagattatggagttatggattttgcgt

SEQ ID NO: 50176 - DNA, 101 bp, rice(Oryza sativa)
  misc_feature (71): n=t or g
ctactactggctcagtataacggtgtttaggcatgtgtcttagggtttttaatggaacttcatgggttgtnagatggcacgaacattgagtttctaattgt

SEQ ID NO: 50177 - DNA, 101 bp, rice(Oryza sativa)
  misc_feature (71): n=t or c
atttcccacggttcaatctcactccacccccatattacattgatcgagacaagatcctgaacacgcgagangagactctggcatcaccgctactgatcctg

SEQ ID NO: 50178 - DNA, 101 bp, rice(Oryza sativa)
  misc_feature (71): n=a or g
accccatgataagtacaatcccaaaatccatatctagggtacatctgaagagaggatgagatgcatgtcantgtaagcaaatatgtgattcaaagccaaga

SEQ ID NO: 50179 - DNA, 101 bp, rice(Oryza sativa)
  misc_feature (71): n=t or c
cccttttaaaattttctatttcctcgtttttcatgcgcccattaagactcatagtactaaatagtaagtgngctttctcaaaataattataaaaaatattc

SEQ ID NO: 50180 - DNA, 101 bp, rice(Oryza sativa)
  misc_feature (71): n=t or c
tcttccaaggcggcacgataagtgcgaggcactggagagagggtagttgcgttgaggttgtagcgtgtaanagggaggtggatgtcgtccttgccgcgagt

SEQ ID NO: 50181 - DNA, 101 bp, rice(Oryza sativa)
  misc_feature (71): n=t or c
aagaataagagagatggaaaaactgaagcctgttcttctcaagatatctcatcctatttggccattgctcnataactcttaactgtttttataaaaattgg

SEQ ID NO: 50182 - DNA, 101 bp, rice(Oryza sativa)
  misc_feature (71): n=t or c
acctctgcggctggtttgaggcggatggatccaataaatgtgaggctgcaacagcctgtttttgtgtgttnttttcgtaagtaattagtagttacagcctc

SEQ ID NO: 50183 - DNA, 101 bp, rice(Oryza sativa)
  misc_feature (71): n=a or g
gagttattttttcccgaagaaaattgaacgcagagttttgactgttagctctgatgactaattgcagccgnatcaaatcggcgagatcattgtgctgcagt

SEQ ID NO: 50184 - DNA, 101 bp, rice(Oryza sativa)
  misc_feature (71): n=t or c
aggggccctattgaacgcccattgttcgacagggacggtggctgggacatgttgaacagccgcagtttganaggccctgcccgctactcccattgttcgat

SEQ ID NO: 50185 - DNA, 101 bp, rice(Oryza sativa)
  misc_feature (71): n=a or g
agaggtgatcctccaaatctattgtggtgtcgttattgttgagaaggtgggtgatggatctcaacttctantagatgactcggaatcgccgcctatttatc

SEQ ID NO: 50186 - DNA, 101 bp, rice(Oryza sativa)
  misc_feature (71): n=a or g
ataaaccctaaaacgataaatacgaacaaaacaatttataattagaacttttatatgtgtgttatgcacgncttaaaaaccaatgctacaaaatcaactta

SEQ ID NO: 50187 - DNA, 101 bp, rice(Oryza sativa)
  misc_feature (71): n=a or g
tatatagataaagtgtgcttctttattcatatggttggtactgattgtgcgtgtatgtatagtgtgtttgnttgctagctacactttaccacaattaaagt

SEQ ID NO: 50188 - DNA, 101 bp, rice(Oryza sativa)
  misc_feature (71): n=t or c
gttccaatacaaaccagaatttctctgcattattgatggcaaaatgaactgagtaacggacacacaagaanagataaacagatgacgaaaagctcaatgtt

SEQ ID NO: 50189 - DNA, 101 bp, rice(Oryza sativa)
  misc_feature (71): n=a or g
ggcgaggtcgtcgctgccgaagttagtggcgatgtccaagttagcggcgaggtcgccgccgctgtcgaacncggcattggcgctgccgccgccgctgccgg

SEQ ID NO: 50190 - DNA, 101 bp, rice(Oryza sativa)
  misc_feature (71): n=a or c
agtagctcagatgtgtgtttgaacagttcaattcaaactcatcacgcatctttgttaactggtgtcacgcnccgaactagtaccgaccggaactagcccgt

SEQ ID NO: 50191 - DNA, 101 bp, rice(Oryza sativa)
  misc_feature (71): n=a or g
cgccttgtacgccggatttgagaccatgatcttgatcttcttgtctccttcttctttctcaatctcggccnccggagcttcggtcgtgccggagagatgcc

SEQ ID NO: 50192 - DNA, 101 bp, rice(Oryza sativa)
  misc_feature (71): n=a or g
aagacacactactaaaaacgattttcctgtacaaggacatgtttagattacagatagaccgtaattggtcncgttctgaaaaaatcatcgtcctcccattt

SEQ ID NO: 50193 - DNA, 101 bp, rice(Oryza sativa)
  misc_feature (71): n=a or c
tatattatttttcttttggcttttttagtgtatttgctaggtgcactgcatgccatgccatgccagtgtanttggagacactggccgtggtgtaaatgtat

SEQ ID NO: 50194 - DNA, 101 bp, rice(Oryza sativa)
  misc_feature (71): n=a or c
acaaagtgcacgtcatatgcacacaagctacaccaatgagcaatgcaacggatagagaacagaggagttgntggcacattgtattggaagcacggcaagga

SEQ ID NO: 50195 - DNA, 101 bp, rice(Oryza sativa)
  misc_feature (71): n=t or g
taagtaattttcgtgacatagaattagtctgatgattagaagggatcttcacgtactttcttatgagtctntataactgaaaaaatcaactcaaactaagc

SEQ ID NO: 50196 - DNA, 101 bp, rice(Oryza sativa)
  misc_feature (71): n=t or g
tcaacccatttgagttgatagctctatttttcttgtctagtttgagttatgttcgtgcttttgccattttngctactttttattgtcttaggtgtatgaag

SEQ ID NO: 50197 - DNA, 101 bp, rice(Oryza sativa)
  misc_feature (71): n=t or c
ttggtaagttttcttttttgtggtatcgtcacaaatctcacatgaacacagtacacactgacaatgatggncctaatacactcttttggtggtcccagagg

SEQ ID NO: 50198 - DNA, 101 bp, rice(Oryza sativa)
  misc_feature (71): n=t or c
ttcagaactgcgactaacttgttccattttgatctaagaaatctatctagtatactactcccttcatctanttttgatagtcatatttttaaatctgaaaa

SEQ ID NO: 50199 - DNA, 101 bp, rice(Oryza sativa)
  misc_feature (71): n=a or g
gacaaacttttggccttttgggtcttggaaccacacatttggagatgccagtggtgtattgtggacattgngtgtaattcagtggcataaattggatccct

SEQ ID NO: 50200 - DNA, 101 bp, rice(Oryza sativa)
  misc_feature (71): n=a or g
ctaaaacaattaactaggcttaggtctactcccagtgtcccaaaataaaataattcctcatcccaagaagnttttagtaaggagggaaaatgactaagttc

SEQ ID NO: 50201 - DNA, 101 bp, rice(Oryza sativa)
  misc_feature (71): n=t or c
acgtgttttgatcgcctgcaaaaccctttttcctagtagtgcaagaagggcaaaattctattttctccacnagtttccatctccaatatttgtcaccaccg

SEQ ID NO: 50202 - DNA, 101 bp, rice(Oryza sativa)
  misc_feature (71): n=t or c
tctatgcggtaccaggctcgtatatggaacttggggcacctaggaagctaacccgaaggccagcaaagtcnggcgaagtctcaatgaaaaagaaccgagct

SEQ ID NO: 50203 - DNA, 101 bp, rice(Oryza sativa)
  misc_feature (71): n=t or g
tttgtatggttttttttttttgtcatcacagtgatttgtaacagagacgcttgggtttagtagtagtcatnccgtatcagcacacaaattcgatgccatat

SEQ ID NO: 50204 - DNA, 101 bp, rice(Oryza sativa)
  misc_feature (71): n=a or c
tctttctagctttttgtgtggcatctgcatcatgcagatcatgcctggctggatttttacccttgcattcnacaaccaaatctttagcttgagttgctatt

SEQ ID NO: 50205 - DNA, 101 bp, rice(Oryza sativa)
  misc_feature (71): n=a or g
ccgtcaggcgtcaacatgggtcatcaaatgcccaatcagaaatattgacgacgatttcttctaagctccanaaaattaaacaattagaaaattatcaataa

SEQ ID NO: 50206 - DNA, 101 bp, rice(Oryza sativa)
  misc_feature (71): n=a or g
ccactggtgagtagtgagtggctagtgactggtcagttcatcacttgtgaaggttttgcaatcaggaaaanttcagaagatcatgggcaagctctggacaa

SEQ ID NO: 50207 - DNA, 101 bp, rice(Oryza sativa)
  misc_feature (71): n=t or g
caacttaaaaatgcatgcatatatacttcctgaatcacactacgctatgttagctgcaatgttgaaggatnttcaaaattgtatttcagtccttgttcctt

SEQ ID NO: 50208 - DNA, 101 bp, rice(Oryza sativa)
  misc_feature (71): n=t or g
tctggaggaactcaggcaaaagtattgcctccttggttggatcgcatgtcaactagctgaggacatcaagnctttttctattgatcagaaagtcaagtaag

SEQ ID NO: 50209 - DNA, 101 bp, rice(Oryza sativa)
  misc_feature (71): n=t or g
ctcacatgaaagtaccttaagagaacagtatgcacaaatagaaccgtctcttggaaaatgtgaacactccnatttcatgaaagaaatcataacttcttcat

SEQ ID NO: 50210 - DNA, 101 bp, rice(Oryza sativa)
  misc_feature (71): n=a or g
gacgctgccgacactccgcctccaccggtgatatagatggtcaaatgggtcatctaacacggcctcgcccngacacgactagagcacaacccaaggcaaaa

SEQ ID NO: 50211 - DNA, 101 bp, rice(Oryza sativa)
  misc_feature (71): n=t or g
ccatatggtgggcggtgggattttaatagcatgaaaatttgtttcaccagcagtgctctttacctacctcnagtaaaaacccgattttcgctagcggacac

SEQ ID NO: 50212 - DNA, 101 bp, rice(Oryza sativa)
  misc_feature (71): n=t or g
ttttctgtagttaataaagcggaattttgcttagctgttctgtaattgtcgatttgaattggattggatgncaaaggttacgaggtgatgctgcttgtctt

SEQ ID NO: 50213 - DNA, 101 bp, rice(Oryza sativa)
  misc_feature (71): n=a or g
gacggggggcggggggacataccacctgcgggcccggggggtatattacctcttaaaacatagcccattanaggctcaaaaaacacatctcagtgaaagtc

SEQ ID NO: 50214 - DNA, 101 bp, rice(Oryza sativa)
  misc_feature (71): n=a or g
ggatggttatgctttgtttaggttcagtttgttaataccagggtttttgctgatttttcacaaattaactnagccattgtaaggcttttgggtccgatttt

SEQ ID NO: 50215 - DNA, 101 bp, rice(Oryza sativa)
  misc_feature (71): n=a or c
caaatcaaccatgacgaagtgaccccgggccggcagacaaccgtgattggtacacggagctatctcgaccnggaatgcatcaggacgtcgatagtaagcgc

SEQ ID NO: 50216 - DNA, 101 bp, rice(Oryza sativa)
  misc_feature (71): n=t or g
gcaactgaaggctatgactaggggtttaggtcacctttcagtagtgaaagctgattccttaactgcagagnttgttgataacaacaatagtaatggcaagc

SEQ ID NO: 50217 - DNA, 101 bp, rice(Oryza sativa)
  misc_feature (71): n=t or c
ttgtgtgtcgggagggaaggttctcacctttactaacgaaaccggcctaaggaggattaattccacacctnaatatataggtgtgaaataaatcccctttt

SEQ ID NO: 50218 - DNA, 101 bp, rice(Oryza sativa)
  misc_feature (71): n=a or g
aagacttgtttcatgctttcatctactcgtgtatcgaggactatgtagtcgcagagtaaattgaacagttncattcaaagtataaccaaagttcgacaaaa

SEQ ID NO: 50219 - DNA, 101 bp, rice(Oryza sativa)
  misc_feature (71): n=a or g
tagtgtatctactaccctgaaaaacatccaaaggtttgtgtaaaccttacaatttcaatcataatttgttngtgcatcaaatgggtttgacgtattaagtt

SEQ ID NO: 50220 - DNA, 101 bp, rice(Oryza sativa)
  misc_feature (71): n=t or c
ccataaattcacagacaaagtagaatgtctaagcatactccgtaccatgtccataagtgtacgattgcgangctcagccactccattttgttgtggttctc

SEQ ID NO: 50221 - DNA, 101 bp, rice(Oryza sativa)
  misc_feature (71): n=t or c
cttatcccttacaactttcctccgtggcaatgtatggagcaatccaacttcatgatgtgcctacttattcntggtccgacatgccctggaaaggatatgga

SEQ ID NO: 50222 - DNA, 101 bp, rice(Oryza sativa)
  misc_feature (71): n=a or c
cgcgatcgacgccacacgccaacacgtgcatcctatcctaccagtccactcaggcaaatcaaaggcaaccncccatcactccgcatttataaccccacccg

SEQ ID NO: 50223 - DNA, 101 bp, rice(Oryza sativa)
  misc_feature (71): n=a or g
gaaatttctaacgtggcataagaagtttttatagccccaataaccatccaaagtctcttgcgtgttcaagnaaaaaaaaacatccaaagagagcctttgtc

SEQ ID NO: 50224 - DNA, 101 bp, rice(Oryza sativa)
  misc_feature (71): n=a or g
gcgcgcgcgccagctagcaacccctgatgttatccatgtccaaggtgtaaggaacatatatgtatgagtantttgcttcacctgccacataacaaatgagc

SEQ ID NO: 50225 - DNA, 101 bp, rice(Oryza sativa)
  misc_feature (71): n=a or g
gctatgctgatgtccgaactttcaatggtgtgacatattcaacattttaagaagcgtgcgaagctagaggnctccttgacagtgataatgaatggcatttg

SEQ ID NO: 50226 - DNA, 101 bp, rice(Oryza sativa)
  misc_feature (71): n=a or g
tagaaattgtcacaatctgagaattccgtggaagcatatgagctgtaaattgggttaatgatcttgtggtntccgattacagatttttgcgaaacaaacag

SEQ ID NO: 50227 - DNA, 101 bp, rice(Oryza sativa)
  misc_feature (71): n=a or g
tttcaagggtgccatttttactggatgctggaatcctttctgcaggtaaagtgggaacttcatcagttganaagattggtgtgtctgaagtaccttcaaaa

SEQ ID NO: 50228 - DNA, 101 bp, rice(Oryza sativa)
  misc_feature (71): n=t or c
ttgagtccaagtgatattagctcatctccgataggtttatatttaggttgtgttctttaccctgtttttcnaactcgtcacccttattttttacatgcata

SEQ ID NO: 50229 - DNA, 101 bp, rice(Oryza sativa)
  misc_feature (71): n=a or g
gaagattataatgtatatttgtatttgtaatgtacttgaccaactttaatatgccattaaattgaagatcnaacagacttttgatttacgagaccaatctt

SEQ ID NO: 50230 - DNA, 101 bp, rice(Oryza sativa)
  misc_feature (71): n=t or c
agcccacaaagagcccattttaggcccagtaagaaaatgggtgaggttcaggcccaccaagatttctgctngatgcgcaagcttcaggtgaagggctgtct

SEQ ID NO: 50231 - DNA, 101 bp, rice(Oryza sativa)
  misc_feature (71): n=a or g
cgagcgggtcgacatccttatccgatcgcatctcaccccgctttctcaactccttgatcctcctccactcntatcggtccccttccctcttgccccctctc

SEQ ID NO: 50232 - DNA, 101 bp, rice(Oryza sativa)
  misc_feature (71): n=t or c
ttttttattcgcgcgtatttttcttttctctgtacggacgacggaaatttctttaccggttttaactcacngggccatcgtttggtttattaggtatattt

SEQ ID NO: 50233 - DNA, 101 bp, rice(Oryza sativa)
  misc_feature (71): n=t or g
tgagcccacctttgctggcgtggtgaggctccacattataacacgtctatatctctgctattataaaaacngaagatgtttttatctgtattttagcacgt

SEQ ID NO: 50234 - DNA, 101 bp, rice(Oryza sativa)
  misc_feature (71): n=a or g
tggacacatgctatagctagcaggttaggccgcttgacacgacaaatcgaactggtcatattgggttccangcagggggcgctactgtgtactcaccgcga

SEQ ID NO: 50235 - DNA, 101 bp, rice(Oryza sativa)
  misc_feature (71): n=a or g
tcatgcgattccatatccagttttcatcccattagacaaaagctaggtcaagatgcctcgtggatgccatnaagggcaaaactgttgtccaatccactgag

SEQ ID NO: 50236 - DNA, 101 bp, rice(Oryza sativa)
  misc_feature (71): n=a or g
agaatagtagttatattgagattttcggtataaatagagggatgctacgtcttaagggtagtccaagtttnagagattaattaggtagggtttcgtgagaa

SEQ ID NO: 50237 - DNA, 101 bp, rice(Oryza sativa)
  misc_feature (71): n=a or g
cccaacctgacctgccaatgatgtccatccattgctgatggattcggctggccaccccaaaattcaggcangttcaggagaccgccatcctccactacata

SEQ ID NO: 50238 - DNA, 101 bp, rice(Oryza sativa)
  misc_feature (71): n=a or c
tgcaagttgcaactaacatttgtacggtcaaacgttatctgaactaattttcttgttgacggataagggtntgatttgttcgccaaattctgttgtttctt

SEQ ID NO: 50239 - DNA, 101 bp, rice(Oryza sativa)
  misc_feature (71): n=a or g
ttgcaagatggtgcacatgctatttttggaccatcgggtggagtatttgctggagcctggttttcttctcnagtaagctattttcatgatggaggatggga

SEQ ID NO: 50240 - DNA, 101 bp, rice(Oryza sativa)
  misc_feature (71): n=t or c
agattccaaatggagacagggctttcatgctgaattaagaaaggtttcttaagactaactatagattctgntgatttaattaatcttgtctatatatgcag

SEQ ID NO: 50241 - DNA, 101 bp, rice(Oryza sativa)
  misc_feature (71): n=a or c
ctagtttgttgataactaattattagcaggttgaacaataacttaaccgtgtgtgcatgcgtgcgtttggngtgcaggccgacgttctaccgggtgtaccg

SEQ ID NO: 50242 - DNA, 101 bp, rice(Oryza sativa)
  misc_feature (71): n=t or c
ggagtcggcgcaggagcctgaagaggagtcactgcagaagcttgagtaggagcctgatgcggagtcggtgnaggagcctgaggaagaatcggtgcaggagc

SEQ ID NO: 50243 - DNA, 101 bp, rice(Oryza sativa)
  misc_feature (71): n=a or g
atattaaaggaggagaaccgacgaaatatcttatctcttttgatggagcgtaataaacatccaggttggtncggaagagttacgctagattgagcaaaaaa

SEQ ID NO: 50244 - DNA, 101 bp, rice(Oryza sativa)
  misc_feature (71): n=a or g
tgttggcttacgtggaggttgaaaacccagcgtgtactgctcctgccgtaagcaaaggtggaggtgacaanctgacggggacacggatggacggtcgggat

SEQ ID NO: 50245 - DNA, 101 bp, rice(Oryza sativa)
  misc_feature (71): n=t or c
ataaaattcatggaactacgtgccactactctctctctcctctctcactctatccatgcatgcatccatgnattttagcaatcttcaaaatgattttttct

SEQ ID NO: 50246 - DNA, 101 bp, rice(Oryza sativa)
  misc_feature (71): n=t or c
tggaaaagcacataaagcacaacaactcctaacatagaaccctaaacttcagaacctagccaaccccaacnagcgacgaagcttgttgacagcgctcgcat

SEQ ID NO: 50247 - DNA, 101 bp, rice(Oryza sativa)
  misc_feature (71): n=t or g
atttcaaaaagaggacttttgtggtacaaattacatggtggtaatgtactgccggtataaacaagggcatnttaggttttagcctaaaagttgacaacaga

SEQ ID NO: 50248 - DNA, 101 bp, rice(Oryza sativa)
  misc_feature (71): n=a or g
ctatattaaaaaaaaagagaggtagtttatatatatgatagacacatagtatatattctgtttgtaacttnccttacttaccacgctgtcgctacctaccc

SEQ ID NO: 50249 - DNA, 101 bp, rice(Oryza sativa)
  misc_feature (71): n=a or g
ataaccggaaacggaggggaaggtaacctgagttagacaagacaacagtcactaaacaatggtcattgatnaaagttgtgtttgttaattatttgtctttc

SEQ ID NO: 50250 - DNA, 101 bp, rice(Oryza sativa)
  misc_feature (71): n=a or g
taatccgtatgctcggtgtcacatcacgacatgattggaatccgttcgcgtgaattataggtgcgtgtccntttgcgaattaggttttttgcattagtatt

SEQ ID NO: 50251 - DNA, 101 bp, rice(Oryza sativa)
  misc_feature (71): n=a or g
gaagcatgggcatatagtggaccacaagctgtaatgcttgtatgaaaagttattagcgaccggttgatggncctaccaacagctgaataattgaggctgaa

SEQ ID NO: 50252 - DNA, 101 bp, rice(Oryza sativa)
  misc_feature (71): n=a or c
agctttatataaggtggagtatagtggggaatattgcagggttgaatgtaattggtgaggtgatgaatatnaaaaatggatgtggagattatggatacctc

SEQ ID NO: 50253 - DNA, 101 bp, rice(Oryza sativa)
  misc_feature (71): n=a or g
aacaggattcttcttcccaataagcaaaagcagcgaattccaacgaaagacgcagccaccgtcctcacctnagccggaaatcccggacgcggaagagaaga

SEQ ID NO: 50254 - DNA, 101 bp, rice(Oryza sativa)
  misc_feature (71): n=t or c
cccctactcccgcaagatgacgaggacaaggacaaggatggggacggtgacaagatgacgacgacgacgangacggcttcgagcaacgatggcgacaatga

SEQ ID NO: 50255 - DNA, 101 bp, rice(Oryza sativa)
  misc_feature (71): n=a or c
tatgaccagccaaattagtcagaaacgtagactgttttaattgtcaactgtcgtaaggtcagagacacggnaacggcgaccaaccaaactctactcggctc

SEQ ID NO: 50256 - DNA, 101 bp, rice(Oryza sativa)
  misc_feature (71): n=a or g
aagaagggcatacagcttttgcaactaaagaggaggctgacgaagaggtactgtacttgtttttgcaaccncagttcatcagggttaactgccatattgaa

SEQ ID NO: 50257 - DNA, 101 bp, rice(Oryza sativa)
  misc_feature (71): n=a or c
tgggagcgctacctcttcagtatccttaattaaccccccctctctctctcttaacccaattaatcattttntttatccttgtgttgtttcttgtcaaattc

SEQ ID NO: 50258 - DNA, 101 bp, rice(Oryza sativa)
  misc_feature (71): n=t or c
tggaactcttgaagccaccaaaagccagttacatgaggtcagagagctcgcgagaaaaactgagcatggtntgaggaatagaatctctgagcttcaagaat

SEQ ID NO: 50259 - DNA, 101 bp, rice(Oryza sativa)
  misc_feature (71): n=a or g
ataattagatgacatctaatatgcattgtgttatcaagtactgataatggacaatactaagtgaaaaaccntcaacagatgatagataagtattgatacta

SEQ ID NO: 50260 - DNA, 101 bp, rice(Oryza sativa)
  misc_feature (71): n=a or c
cctctctacgcagatcaagtatgccaaaagatcgaagcccatccagcccattgggctggaatatatatctntataggcccaacaagctacaaccttcggcc

SEQ ID NO: 50261 - DNA, 101 bp, rice(Oryza sativa)
  misc_feature (71): n=t or c
cactttgtcattactaaacttggcgcatgcatttatctaaccatgggacacaagttaaacagaaatctagnttcctgatggcatgtgagctcccaatccga

SEQ ID NO: 50262 - DNA, 101 bp, rice(Oryza sativa)
  misc_feature (71): n=a or g
aaaccatgcttgaaatccaactgtagagcaattggattggtaatttaaattggttggctccttccttgaangtacaaatgcatgtagctaacttgtgtgct

SEQ ID NO: 50263 - DNA, 101 bp, rice(Oryza sativa)
  misc_feature (71): n=a or g
aacagttggataatttttagctcgcaagattaaatcagtggaacaaagaaggctaatatatactccctccntactcataaaagaagtcgtttaggacagcg

SEQ ID NO: 50264 - DNA, 101 bp, rice(Oryza sativa)
  misc_feature (71): n=a or c
gattggaatgaaaaaaatcgcaacatcaacaaatgcgaggaaaatcggtcgctttgctgcgcatacataantgtgccgagacccaaaaatattattaacac

SEQ ID NO: 50265 - DNA, 101 bp, rice(Oryza sativa)
  misc_feature (71): n=a or g
tgtcctgtcgattgttatcgagaacgaccaagtgtgcatgacaatgttgacaaagaaaacgcggatgacancgtgaattcatttgagttgaagtcggtggc

SEQ ID NO: 50266 - DNA, 101 bp, rice(Oryza sativa)
  misc_feature (71): n=t or c
gtgacatctaatcagcaaataagtttttaaaagaaacatagggcatacccatttctatctcattgcacctntctctctcccgagcttcccagtggcaagga

SEQ ID NO: 50267 - DNA, 101 bp, rice(Oryza sativa)
  misc_feature (71): n=t or g
tactgttgtgatcatatgctcagagaacttgagaacttagtggtgtcctggtctaatgcagtacaaactcnagtactctctccttctctaaatgtttgacg

SEQ ID NO: 50268 - DNA, 101 bp, rice(Oryza sativa)
  misc_feature (71): n=t or c
aaaaaaaaaagtagaccaatgaacttgccaacacatgttccatttgcacaaagtatgtgattgattcttgntaaataggaccataggaaagaacttgccag

SEQ ID NO: 50269 - DNA, 101 bp, rice(Oryza sativa)
  misc_feature (71): n=t or c
accatttccgttttgggacaggtagggatagctttttcttggctattgttttcatccctactgtttagtangagtagatttctttgttttgtaatacggtt

SEQ ID NO: 50270 - DNA, 101 bp, rice(Oryza sativa)
  misc_feature (71): n=a or g
ccatgcacattcgtgtcatatctcacgatgtccatctgatcagggggctgctatgctacacataatgcagnggtatcagggtataacattcttactagttg

SEQ ID NO: 50271 - DNA, 101 bp, rice(Oryza sativa)
  misc_feature (71): n=t or c
ctttaatatttttatccaagattagtttagcccctccaagtacaaagtacagagcaacgatactacccttnaacaacggaaattatatagtagaaacataa

SEQ ID NO: 50272 - DNA, 101 bp, rice(Oryza sativa)
  misc_feature (71): n=t or c
atggaatatttgcaaggtttcgttactgtacagttcaaatccaagtggagtataggcatccaatgcctacntgcataattgatcggtaatctgaccagaaa

SEQ ID NO: 50273 - DNA, 101 bp, rice(Oryza sativa)
  misc_feature (71): n=t or c
actctattgcaaaaataactggaatggaaatttatgattatttgttattgagcttctaatagcatactgtnttttggtgaaatacaatgttttttttaatc

SEQ ID NO: 50274 - DNA, 101 bp, rice(Oryza sativa)
  misc_feature (71): n=a or g
atgcgctgcatatcatcaacctgcatcacgtcgatttacagccacatcaccttattgccctggcaaacccnccccttgtcgtcattctcatggaagttgat

SEQ ID NO: 50275 - DNA, 101 bp, rice(Oryza sativa)
  misc_feature (71): n=a or g
tgtcttagtggttctggagtccatttactcgaagggtcgtatgtgtttgttagctggcgttgccatttctngggacttgttaggagtgtaacgtggctcag

SEQ ID NO: 50276 - DNA, 101 bp, rice(Oryza sativa)
  misc_feature (71): n=t or c
taaaattatcatagcattaattattatatgtcggcctcatgcattgtgatgtctttaggaccttaaacaanaatagtttatttaattaaaggaatacaaca

SEQ ID NO: 50277 - DNA, 101 bp, rice(Oryza sativa)
  misc_feature (71): n=t or c
gatggtaacaacaagcatgagcttgccttcaaaagcaggttcaaagaacaacaaacatggtccaaatgatngcggatctaatgttagcaaagcggtatctc

SEQ ID NO: 50278 - DNA, 101 bp, rice(Oryza sativa)
  misc_feature (71): n=t or c
caaggatttttctccaattttttcttttgcaacagttccgagtattttagtagttgcctcagccttcatgnagggcattgttcggagtactgctctccaat

SEQ ID NO: 50279 - DNA, 101 bp, rice(Oryza sativa)
  misc_feature (71): n=t or c
ttttttctttacctctagagaggaacaaagagagaaaaagtctcatttttccacgcgtttactttccgaantgttaaagaatgtttttttaaaaaattgat

SEQ ID NO: 50280 - DNA, 101 bp, rice(Oryza sativa)
  misc_feature (71): n=t or c
caatggaactatgtcttcagatcggtagggggcgggcaataggtataatacctagctcggtctggtcgganggtagcgacgtcgttttccctcctgggggt

SEQ ID NO: 50281 - DNA, 101 bp, rice(Oryza sativa)
  misc_feature (71): n=a or g
cggcaatatgcactgcctatgcatcatcaggcagcgtgtagtcagcggcaatatcccccgcctgcgccacnccgcgcgcccaacattgtacacgacctcct

SEQ ID NO: 50282 - DNA, 101 bp, rice(Oryza sativa)
  misc_feature (71): n=a or g
caccttggggaacgtcgcattcacctctgggagcgcctgattcgtcgtgcccttgccatctccgatcaccntggtcctgctatgccgtgtgccgctctgtc

SEQ ID NO: 50283 - DNA, 101 bp, rice(Oryza sativa)
  misc_feature (71): n=t or c
atcaacaaccggaccaactaaacactacatttttctccaatactttcggcaaaaacattgcgcacatcgtngataaaccaaactttaccacctaaatgcaa

SEQ ID NO: 50284 - DNA, 101 bp, rice(Oryza sativa)
  misc_feature (71): n=t or c
atcttgcactatggtggacaaacaactcacaactctgtcaacatgcccttgaaattacccttggtgatggngccaaaactagtttttggaatgacaattgg

SEQ ID NO: 50285 - DNA, 101 bp, rice(Oryza sativa)
  misc_feature (71): n=a or g
aaggcttactacttttcagaaaacccaatgtacaacgatacccagttccgtcggaggtataggacgaaaangcatctatttctacacattgtgcaaactct

SEQ ID NO: 50286 - DNA, 101 bp, rice(Oryza sativa)
  misc_feature (71): n=a or g
ttcacttcagcctgcacaaattgaaaggaagataatgtcatacacagtgcaaacttgacaggaaagaatcngccagtgggtactaaccagccattccctgt

SEQ ID NO: 50287 - DNA, 101 bp, rice(Oryza sativa)
  misc_feature (71): n=t or g
ggtccatgaatttttaatatacgcttgtataagccgttccaaagagattcccgttccaaagagattcacancccatcttttcgcttatgcttatgcttatc

SEQ ID NO: 50288 - DNA, 101 bp, rice(Oryza sativa)
  misc_feature (71): n=t or g
ataaaccataatccgtcgaatcctccattaaaaaaaaaccacacgctttagacccgatgctctcatgtcancacttgtggtatatgtccgtgttactatat

SEQ ID NO: 50289 - DNA, 101 bp, rice(Oryza sativa)
  misc_feature (71): n=a or c
agagctgggattttggaaaaggaatgtgaattcgtaaaatgcaatatcttggtcccgcacagcggcgaatnaagctcccaggccggacaaatggccgcctg

SEQ ID NO: 50290 - DNA, 101 bp, rice(Oryza sativa)
  misc_feature (71): n=t or c
ttttttcaggacggaggggtagataagtgtgttagtgggcaattaaccacgtgagtgttgtcggctaggtnctgctgcctgccagtcgttagataagccgt

SEQ ID NO: 50291 - DNA, 101 bp, rice(Oryza sativa)
  misc_feature (71): n=a or g
tataatttaactcctaaaacagtattgatagtggtattcactgatgtggcatccggaaatgctactgagcnttgcccagagcgatcgattcccccctccct

SEQ ID NO: 50292 - DNA, 101 bp, rice(Oryza sativa)
  misc_feature (71): n=a or g
gctgcctcccccatctggccatcccgatcccaactaacagaagatatggttagggagagggagagatgagntatatgaaaagtgggccccacaatttttaa

SEQ ID NO: 50293 - DNA, 101 bp, rice(Oryza sativa)
  misc_feature (71): n=a or g
ccgtcttgtgggtgcttgtcacacccggagagtttcccctttttcgtagtttctaattcaccaataaattntctataaaaattactttgattaaccaggag

SEQ ID NO: 50294 - DNA, 101 bp, rice(Oryza sativa)
  misc_feature (71): n=a or c
gagtgtgaaggcgagatgttgacggcgaaaagggacactagctaatctgtgctgctcagttgcttctttcncttgccgtgtcataggtgtcaagtcagatt

SEQ ID NO: 50295 - DNA, 101 bp, rice(Oryza sativa)
  misc_feature (71): n=t or c
gaaaccgcttcaacggaggcgcagcggttcacgcaggatatgtcgaaagccactgaatctgccaagaccgngtgccgtacgcttcgccttgcccttactga

SEQ ID NO: 50296 - DNA, 101 bp, rice(Oryza sativa)
  misc_feature (71): n=t or g
ccttatgttaagttcgaatttgtgcttagattaaccctgcgttttcacttaccttttcactttcaactttngcctctgaatattagtatataatcaattgt

SEQ ID NO: 50297 - DNA, 101 bp, rice(Oryza sativa)
  misc_feature (71): n=a or g
agagtagaccccagaggcttatcgttggcgttcagtatcatacacagaaattacctttcagaaacgccacnaaattaaaccccgtctcaggaaaaacacga

SEQ ID NO: 50298 - DNA, 101 bp, rice(Oryza sativa)
  misc_feature (71): n=t or c
tgaagtagcaactcaacgggattgtgttggtggtggtgggccatcgtcattccattatcaacggctactcnagttgctaacattatttttgtcattttgta

SEQ ID NO: 50299 - DNA, 101 bp, rice(Oryza sativa)
  misc_feature (71): n=t or g
ggttgagtgcggctgttctggccatatattttatatttggcttgtcctgaagatcctaccgtaatagatgngttccattggttttctgaaagttcccagct

SEQ ID NO: 50300 - DNA, 101 bp, rice(Oryza sativa)
  misc_feature (71): n=t or c
ccagcactgtagaacgtgagtagttgatgcatatggcaagccacatccttagtaacaagacaaccattttncacttcgtcatcggtaggcatttggatatt

SEQ ID NO: 50301 - DNA, 101 bp, rice(Oryza sativa)
  misc_feature (71): n=a or g
tctataggacaatgcaggactagaaatactatttcatcaacattgaaccaagaccggaaagaggggttaanagcatatacttcatagagaaggtgatgttt

SEQ ID NO: 50302 - DNA, 101 bp, rice(Oryza sativa)
  misc_feature (71): n=t or c
atcgcaactgcattaccccaccagcatccaactaccactagtgtgaagaacccttgcacaaacgcccctcnaccggctagccttatctcacctttgcatgg

SEQ ID NO: 50303 - DNA, 101 bp, rice(Oryza sativa)
  misc_feature (71): n=t or c
tttttcccaagaataagattcttacataagtaggaggaatggccaccgctacgggtacgatcttccaaacntctgtgcatatatgtgcagatatgttcact

SEQ ID NO: 50304 - DNA, 101 bp, rice(Oryza sativa)
  misc_feature (71): n=a or c
ggaagtgcctgggactagtcaaatagtggatcctaagacaaagtaacatcatgcctttcttattcatttgntacagatgaacatactatcagatagaggaa

SEQ ID NO: 50305 - DNA, 101 bp, rice(Oryza sativa)
  misc_feature (71): n=a or g
gaaaattttcagctcatttgttcgcgtaaaaaggcgaggtgggtattacatgatggttgtgatttttgtanatacgcaaaacgaagggaatgggggaaatg

SEQ ID NO: 50306 - DNA, 101 bp, rice(Oryza sativa)
  misc_feature (71): n=a or g
gtttatctccgggttaagtccaccaaacgttcctcatgttttcatcgagcttaaatcatatctctaaaccncaataccgaaaatattcaccctccaactta

SEQ ID NO: 50307 - DNA, 101 bp, rice(Oryza sativa)
  misc_feature (71): n=a or g
ggggaagaagactaaggagattctcaagaagttgtttgagaaagtctataccgcttttgagccattaagcnatgtagatggagaaagtgaatatgaagata

SEQ ID NO: 50308 - DNA, 101 bp, rice(Oryza sativa)
  misc_feature (71): n=t or g
ccaatttactacatacctaaaggaacacaaaaataactgtcaagttctattgattgctgaaaaacaatganatgggtacaaatatcattattttcataatc

SEQ ID NO: 50309 - DNA, 101 bp, rice(Oryza sativa)
  misc_feature (71): n=a or g
caaagtgtagtctgttatacattccctaacgtgccatgtagaaactaaaatcatgatgcagctgcatcctngaaatacatcaataaaatgatggttatttt

SEQ ID NO: 50310 - DNA, 101 bp, rice(Oryza sativa)
  misc_feature (71): n=a or g
agtacagtaggggcctcctcctcctccccgattcttcttcgtgatccgtgcacagtgcacgatgccctgcncgacgctacgcgacgatcccctcaagacac

SEQ ID NO: 50311 - DNA, 101 bp, rice(Oryza sativa)
  misc_feature (71): n=a or g
cgcagacagatgacgacagctcctttactgttactggatcgattgcggcgccatctgcccaaaagcagggngcggcaggaggaagaggcagcagcagcagc

SEQ ID NO: 50312 - DNA, 101 bp, rice(Oryza sativa)
  misc_feature (71): n=a or g
gaccgtgttgagcacgcggtagtccatgcagaagcgccaagaaccgtcatgcttgcggaggagtaggactngcgacgagaacggggatgtgctgggacgaa

SEQ ID NO: 50313 - DNA, 101 bp, rice(Oryza sativa)
  misc_feature (71): n=t or c
aatcttctgccaacgccgcctcacgcggacgtggcaacagcaacgacaacaacttccgcggtcgtggtggnggcggcaatggaggtcgtggccgtggcaat

SEQ ID NO: 50314 - DNA, 101 bp, rice(Oryza sativa)
  misc_feature (71): n=t or c
gtggagtgcaatcctccataatcttgacatgacattattaggcaaacctagctgcttctactgccgattcnctccagtacacatattgcaaaactcttcaa

SEQ ID NO: 50315 - DNA, 101 bp, rice(Oryza sativa)
  misc_feature (71): n=t or c
cagatggcacgaatttgatgatgctccacaaagaccacatgatatgtattttgtccgtgtctctcatcagntgtggtgcccttgaaatgaataaattttca

SEQ ID NO: 50316 - DNA, 101 bp, rice(Oryza sativa)
  misc_feature (71): n=t or c
cgccatcaccacgcggcggaacccaacccaacgcattattattattcccttcccatcccccacccacacanactaggggcccctttgaatcaaaggattta

SEQ ID NO: 50317 - DNA, 101 bp, rice(Oryza sativa)
  misc_feature (71): n=t or c
cgcatacacatacccccaccaacttggcaacttgctcatgttttccataactgtgatggttagaatgcaanagtcactacagttacatgttgaatccaact

SEQ ID NO: 50318 - DNA, 101 bp, rice(Oryza sativa)
  misc_feature (71): n=a or g
actagaccagtgttctagaaaaaaggtctacaaggccacattccagaaaaagggtctacaaggccaagccnctggatacatggaacgggtgccccaacctt

SEQ ID NO: 50319 - DNA, 101 bp, rice(Oryza sativa)
  misc_feature (71): n=a or g
ggccaccctgttgacacagtcttctccaacatcagcaagggagggcactgtatttgggactcagggatcgngcgccatgccctattgatcccgtcttctcc

SEQ ID NO: 50320 - DNA, 101 bp, rice(Oryza sativa)
  misc_feature (71): n=t or c
gatggtttaatgataatgagaagcaattggtatttgtttagttaattgatgaggtttttttttgtactacnttgaacacataaattcggaatattttgttc

SEQ ID NO: 50321 - DNA, 101 bp, rice(Oryza sativa)
  misc_feature (71): n=a or g
gtggagggccaaaaatcaagcctgctgatcaatctgacacttcgaagttgactaatcagtctgactctcgnaagaggaaattgatttcaagcgacgatgaa

SEQ ID NO: 50322 - DNA, 101 bp, rice(Oryza sativa)
  misc_feature (71): n=a or g
gcacgaaaaaataaaattcctaaaaagtaaaaattcaaaaaaaaggaaacctagaatccggcggcggcgcngatccggccattgtctcctgagcctaccgg

SEQ ID NO: 50323 - DNA, 101 bp, rice(Oryza sativa)
  misc_feature (71): n=t or c
tgtttagctacttaacaatttggtatcagagccactccagaacttcctggtttccttgaatcccttgatcnagccggaaaattccatgtgataggtgggaa

SEQ ID NO: 50324 - DNA, 101 bp, rice(Oryza sativa)
  misc_feature (71): n=a or c
taaaaaaacgacggttatttacatgcgcttggacactctatttgatatatccgttttctaaatatgtcacnagaactatttggtaacaaaaagaaatacgt

SEQ ID NO: 50325 - DNA, 101 bp, rice(Oryza sativa)
  misc_feature (71): n=a or g
acccttttcacattcaaaattaaggatccgccccttctcttactcctctgtctaaaaaaaaataatctcantcctaagtttaaacatacatacatacatac

SEQ ID NO: 50326 - DNA, 101 bp, rice(Oryza sativa)
  misc_feature (71): n=a or g
tgaaccttccgatttggttgtgtgtgcaaggaggtatcgcaaccgacacacatacgaggggattcagtacnttatctcgaggggattcagtacgttatctc

SEQ ID NO: 50327 - DNA, 101 bp, rice(Oryza sativa)
  misc_feature (71): n=t or c
actactacactaacattatcttcccaactaatcaaaatccttataaccattcaatttacccatcaatttcnacttctcaactaaccacaacctcgcttcat

SEQ ID NO: 50328 - DNA, 101 bp, rice(Oryza sativa)
  misc_feature (71): n=t or g
aacccagatggacattatacaatacattctgtgtatatacagacttctgcgaaactcatctttaatcctgntttgcaacccccttcactcccgggttacca

SEQ ID NO: 50329 - DNA, 101 bp, rice(Oryza sativa)
  misc_feature (71): n=t or c
gctagaattacctagtagaaagtataaatttggctctgttcgctgcttgttgttcccaaccggaacagtgngcatagaaaatggagtagtctactagcatg

SEQ ID NO: 50330 - DNA, 101 bp, rice(Oryza sativa)
  misc_feature (71): n=a or g
ttgtaaatgtactccaaaggcttccccaattgtgggcctacaagaccatggtttgatgggccgaaagtgcnctagcaggcgaagctgcgccaaacagcatt

SEQ ID NO: 50331 - DNA, 101 bp, rice(Oryza sativa)
  misc_feature (71): n=a or g
tgttcggtgttgtttctattgtcgatacaaccaccagcctatttacacgtagtcttttgacatatccacangaccacaactaacatagctacatattagta

SEQ ID NO: 50332 - DNA, 101 bp, rice(Oryza sativa)
  misc_feature (71): n=t or c
catcatctctaggtatgcaagcaaagtaagagtgttagagatatacatttctcttatgcttattgttggtnttgtggataagacatacccaatgatcttgg

SEQ ID NO: 50333 - DNA, 101 bp, rice(Oryza sativa)
  misc_feature (71): n=t or c
acatatcacaattcatatactctgcaaatgtgtgtcgttgtacccatagataccttaaacctgttaacatngcactacattgccaccatgctagtgcctaa

SEQ ID NO: 50334 - DNA, 101 bp, rice(Oryza sativa)
  misc_feature (71): n=a or g
atagagtctgttaggagagtttaatattctgacaaacagttgagaaacagtttgttagtagccagtttatnaaaatctagaaaaagctgggttttctagct

SEQ ID NO: 50335 - DNA, 101 bp, rice(Oryza sativa)
  misc_feature (71): n=t or c
atctattaaagcctataacatcttgcacctgggctctagttataagggtttggtgttgtgaaatttgaacntgtatatttgcgtaacgatacatttgtatt

SEQ ID NO: 50336 - DNA, 101 bp, rice(Oryza sativa)
  misc_feature (71): n=a or g
ttgatcccgtttataaggaaaaccggaccaaaaaccttataacatcatgattaattaaaggaaaaccgacnaaaaccctaacattaattgacgtactgatc

SEQ ID NO: 50337 - DNA, 101 bp, rice(Oryza sativa)
  misc_feature (71): n=a or g
cgcgagtgtcatggggctgtttactgtatcgttggtgtgaagctagctttttgcgtttgctgtgtgcttgncggacccaggattttaaccctgggtgtgcc

SEQ ID NO: 50338 - DNA, 101 bp, rice(Oryza sativa)
  misc_feature (71): n=a or g
cttgtaatgtcaccactgttgctgccctcgagcttacttgatgtcattgtatccctcaatctcacctgacntcgacgttgttgttgtcgtcgttgagctca

SEQ ID NO: 50339 - DNA, 101 bp, rice(Oryza sativa)
  misc_feature (71): n=t or g
taagctatgagccaacaattaacctgatatctttacatctcactgttccttgctaatctgtccgattatgntcatgaaaccatgagacgtgtgcaacggat

SEQ ID NO: 50340 - DNA, 101 bp, rice(Oryza sativa)
  misc_feature (71): n=a or g
aaatttgagatgatgatctgaaacctagccgtacgtgcaataacatttcttgggttaataacggtgttaancatctggaggtacaaattttgttcaaattc

SEQ ID NO: 50341 - DNA, 101 bp, rice(Oryza sativa)
  misc_feature (71): n=t or c
caccgtatccaagccgatctcctccctctttgcttataaatagcacgccctggacctcctctcccttttcnacctttttcccaagtttttaccttgcccta

SEQ ID NO: 50342 - DNA, 101 bp, rice(Oryza sativa)
  misc_feature (71): n=t or c
ttccataggtgtcatatcacttaagcgggtgttgatgcttcaattatacatggttacaaaattgggttggnatgataactattagaagactctgcacttct

SEQ ID NO: 50343 - DNA, 101 bp, rice(Oryza sativa)
  misc_feature (71): n=a or g
acatttcctatatttcattttggttatttgatatgaactaaacagtctttctacgcctcacaggtatacancattttggacaattctcttgtcaagcaaat

SEQ ID NO: 50344 - DNA, 101 bp, rice(Oryza sativa)
  misc_feature (71): n=t or c
agagtacataatccctccggcctaaaaaaaaaaaaaccctggattttttttccaactttaacagttcgtcntatataaatttttttttataattcgtattt

SEQ ID NO: 50345 - DNA, 101 bp, rice(Oryza sativa)
  misc_feature (71): n=t or c
tggatggatgccaatgcaaggcaagataggagtaccagcaggctggcacatctccatttttattggggtangagattcacaaccaatacgacactactagg

SEQ ID NO: 50346 - DNA, 101 bp, rice(Oryza sativa)
  misc_feature (71): n=a or g
gtgccatatctcgtcataccggaagctccgccactggcacaggccatgcacatcttatatagtgaaagcancaagctttcttacacgagaatgtgccacat

SEQ ID NO: 50347 - DNA, 101 bp, rice(Oryza sativa)
  misc_feature (71): n=t or g
atggagtacccattaggccattattttaaataactctgtgtagccctgatataacggtcatgatccggggntagttgtgtctgcacaacagttgtctgtgg

SEQ ID NO: 50348 - DNA, 101 bp, rice(Oryza sativa)
  misc_feature (71): n=t or c
aggagttctgccggaatttaattagagataggaaatatagtgcttacaagccaaatagaggaaaaaccatnagggcggcctgaaagccgacttgcagagat

SEQ ID NO: 50349 - DNA, 101 bp, rice(Oryza sativa)
  misc_feature (71): n=t or c
agtaatcatacaagtgtggaagcttaacacccaaacctaaaatctagcaaacactgcaattcgtattaaantataaagatttaaatttctgagagaacaat

SEQ ID NO: 50350 - DNA, 101 bp, rice(Oryza sativa)
  misc_feature (71): n=a or c
tttgggatggagggggcataaaattgcctagcagaaaaatactattttactcatatctaccccctttgttnccaaatataagcatttctacgttgtttagc

SEQ ID NO: 50351 - DNA, 101 bp, rice(Oryza sativa)
  misc_feature (71): n=a or g
atcaagtaacattaataatgcattacgatactgatgagccaattttctagctccgtccaggcttaacaccntgtattcataatttgcactttggactggcc

SEQ ID NO: 50352 - DNA, 101 bp, rice(Oryza sativa)
  misc_feature (71): n=a or g
agtaccaatttagcagtgcgctaccagatggattccaattcagaattcttcactgtaaaatggagtactantctcgcggtcgctgcatttgactcgcgtgc

SEQ ID NO: 50353 - DNA, 101 bp, rice(Oryza sativa)
  misc_feature (71): n=t or c
aagagtgaaaaggtactagccagcccacactattccaacccaatagcctttagcccataaagtccaactantaccaactctcctctgccctaatttgtctc

SEQ ID NO: 50354 - DNA, 101 bp, rice(Oryza sativa)
  misc_feature (71): n=t or c
taacttttaattctggtgattcaatcaagatgcttctaaggacctcttaggcctattggcctaaaaaaaanagaagcatcgaaaaagaagaccaatgaggg

SEQ ID NO: 50355 - DNA, 101 bp, rice(Oryza sativa)
  misc_feature (71): n=t or c
aacacccccctcttaatcgtcattgaggaccaatggggagttgacacgtggaagctagcggttagtagcgncgaggctagttcggccaaaccacctccacc

SEQ ID NO: 50356 - DNA, 101 bp, rice(Oryza sativa)
  misc_feature (71): n=t or g
gcggagaacgaccaagctgcggcggcaaacggaggggaacacgaggaggcgaacagggacttgccgaatgnagcagggattcgtgccccgcgcgaactgcg

SEQ ID NO: 50357 - DNA, 101 bp, rice(Oryza sativa)
  misc_feature (71): n=a or c
gccacccgccacacacaaaccgtttgcgaaaaccaaaacttaatacaacaaaacttcgactagggcggcangaatagaatatgggtggttctaggaaacgg

SEQ ID NO: 50358 - DNA, 101 bp, rice(Oryza sativa)
  misc_feature (71): n=t or g
tccgaaacctgatttcatttatatacttacgaacgaaattttgccggatgtgaaaactagtttcgtatagnattggtacgtctaaattcaattaatgtgta

SEQ ID NO: 50359 - DNA, 101 bp, rice(Oryza sativa)
  misc_feature (71): n=a or g
gtggggaaactattagtacctgaagagtgcgataagattagtttgaagagtgcagttccagctcagagttnttacctttcacaagccacaaataacaccga

SEQ ID NO: 50360 - DNA, 101 bp, rice(Oryza sativa)
  misc_feature (71): n=t or c
taaaagcggaaagtagtactatatgtttatggttcgtacaaaggttgtcaatgattttgcttgcatgtttnctctgcattattgctcgctcaggtggttgt

SEQ ID NO: 50361 - DNA, 101 bp, rice(Oryza sativa)
  misc_feature (71): n=a or g
taacaacaatgcatagttcttcatactacacatgtcaaatgtgaataaactacatacatactgcaaatcancatcaaaacttacatccaaaacatggaaaa

SEQ ID NO: 50362 - DNA, 101 bp, rice(Oryza sativa)
  misc_feature (71): n=t or c
tttcactagttgtttttagcctccccccatcccaagttacaatttcacagaatgtgcacagtgccgccaanaaaaaaaaattatggtgccgccacgaaaaa

SEQ ID NO: 50363 - DNA, 101 bp, rice(Oryza sativa)
  misc_feature (71): n=a or g
ggaccggctaccaagtgccgactgcactatgcaccgatcgaaaacactacttacctttgacaatttgttcntcacatagattaaatcaacaccttgatttc

SEQ ID NO: 50364 - DNA, 101 bp, rice(Oryza sativa)
  misc_feature (71): n=a or g
tttcttcctcatggcagttttcttcttctgaaaattatacaactatgagtaatcggctgaaaggtgaagtnattacaaaggaaattgaagagagatgctta

SEQ ID NO: 50365 - DNA, 101 bp, rice(Oryza sativa)
  misc_feature (71): n=a or g
atacatacactttagtcaatattatctactatataaccgtatagccaatacccccttatgatgccctcctngtgtttcgagagaccacccttggttgccga

SEQ ID NO: 50366 - DNA, 101 bp, rice(Oryza sativa)
  misc_feature (71): n=a or c
tttttcagtttttcctgtgagcctatcttttcgttcttttccattataaaaacccatctctctttatggtntgtttgttttctatgttataaatgtttttc

SEQ ID NO: 50367 - DNA, 101 bp, rice(Oryza sativa)
  misc_feature (71): n=a or c
acaaccagtcaacagtctgggggagatatatatatatacactacatctattaaagaaaatatacccctctntgtcctaaatatttgactctgttaactttt

SEQ ID NO: 50368 - DNA, 101 bp, rice(Oryza sativa)
  misc_feature (71): n=t or c
aaatcaacctccattttcccatacggctccttgagagttccacatgaaaaaaaaaatctatttttgtaagnggacctcttaaggggccgtatacaaaaata

SEQ ID NO: 50369 - DNA, 101 bp, rice(Oryza sativa)
  misc_feature (71): n=a or g
acctagcccaaggccccaagctaaggcccaagatgactgaacattctcaggcccacccactcccatacccncagtcgcagcggcagcactgcagcctgcag

SEQ ID NO: 50370 - DNA, 101 bp, rice(Oryza sativa)
  misc_feature (71): n=t or c
taataggtgtttagaagccagaaagatgtatagctaaggcatttataggctcatgatggttataatcgaangaaagatcctgtatacacctacaaaatgaa

SEQ ID NO: 50371 - DNA, 101 bp, rice(Oryza sativa)
  misc_feature (71): n=t or g
ctcaattgcattcttgttttggacagtcctatacggctccggctcaagaggatgtaggtagtaagtcttgncctttttggtggcgttgaaccatttttcat

SEQ ID NO: 50372 - DNA, 101 bp, rice(Oryza sativa)
  misc_feature (71): n=a or g
ctacatcgggcttggcatgtacgctgcttaggtcatatctcatgctatggcttgggtgaaaagtttttgcntgtcacatcggatatacaaacacatatttg

SEQ ID NO: 50373 - DNA, 101 bp, rice(Oryza sativa)
  misc_feature (71): n=t or c
aaatatcaatttcaatgtgaaaactgttttaaattcgaaggtacatatttcggagctcggctcatctggantcactgcatttggctttccaagtttttgaa

SEQ ID NO: 50374 - DNA, 101 bp, rice(Oryza sativa)
  misc_feature (71): n=a or c
gatagtgtagtcttatttctcaaacatgaactcaatgaaattggaggtaactctagatccctcatgtcggnctcttaggatccagattgggtttgtcgggg

SEQ ID NO: 50375 - DNA, 101 bp, rice(Oryza sativa)
  misc_feature (71): n=t or c
actttccgccgctccttccccatctctctcttttatcctctccgttacgactcccatggtggtgaccatcngccccctcctcctctccgtcctctcccacg

SEQ ID NO: 50376 - DNA, 101 bp, rice(Oryza sativa)
  misc_feature (71): n=a or g
ccatcctctatttaggtctcttcagactgtgcacaaggaggattattacaatccaaattttgctgtaagtntttgattcctttaacatatacttgtatctt

SEQ ID NO: 50377 - DNA, 101 bp, rice(Oryza sativa)
  misc_feature (71): n=t or g
aaaaaaaacatgccattgttttggccgtcgctgcctttaaacccgttatactttaataagatatgtagatnctactttagtttatgttaacatattttcta

SEQ ID NO: 50378 - DNA, 101 bp, rice(Oryza sativa)
  misc_feature (71): n=a or c
aagtgaggtgtaagtgagattaattggttgtgagaagcagcaatgcatgctccaagaaagttcaagaaggngttcatggagcggctgctgctgagcctgca

SEQ ID NO: 50379 - DNA, 101 bp, rice(Oryza sativa)
  misc_feature (71): n=a or c
gcggtggactggcaaaaacctagctccacaatttagtgaagcaactctgcttattccgctaaaaaaaacgntaaaaaaaaagaatctatactgtttggcat

SEQ ID NO: 50380 - DNA, 101 bp, rice(Oryza sativa)
  misc_feature (71): n=t or c
tgctctctcccgccgatcggatttgtgtttagccatcctagtagtttctttcttcttccttggtttttgtntttttttctctcttcgcctggcataagccg

SEQ ID NO: 50381 - DNA, 101 bp, rice(Oryza sativa)
  misc_feature (71): n=a or g
gcagtgtcaggtgttttggacgaatgtttgtcgctccaaaaccggtggtgagttggggatcactgacctcnggttggcagggtttgccctacgtgttcgct

SEQ ID NO: 50382 - DNA, 101 bp, rice(Oryza sativa)
  misc_feature (71): n=t or g
cgctcgtccatcaaagccatatggatgcttgccctatgctgttccttcgttttagcagtgaattagtattnaaaattaacatgatgtttggatgtgcagcg

SEQ ID NO: 50383 - DNA, 101 bp, rice(Oryza sativa)
  misc_feature (71): n=a or g
tgttcgattttgcatcacatggtatatggtctgagttgtagacctcgcagaattagcaggctatgtatgtngtctttcattttaaatggccctgctatgca

SEQ ID NO: 50384 - DNA, 101 bp, rice(Oryza sativa)
  misc_feature (71): n=t or g
ttgaaaaaatattcttcagaaaacactattgttggagaataaggagagttgttaaaagctgggaacgattncagagttgatgctatattggcaagaagaca

SEQ ID NO: 50385 - DNA, 101 bp, rice(Oryza sativa)
  misc_feature (71): n=a or c
attctagatgggaaatcctcctatatatttttcccaggattactactacaacaagaattattattactgtnctagcaaatatacccgtgcattgcaccggg

SEQ ID NO: 50386 - DNA, 101 bp, rice(Oryza sativa)
  misc_feature (71): n=a or g
gaaaatggataggagcgcatagtatttcgttccatttatagaagctgtagcgtctcacttaagattgctcnatgttcatgttttgtacttttgtgttagtc

SEQ ID NO: 50387 - DNA, 101 bp, rice(Oryza sativa)
  misc_feature (71): n=t or c
ttatgggattcggactgaaatgtccgaatttcgctcatctcggtgaggtctaagacaacttttcacccctnaattcgtctccatctgattcaaatttggtc

SEQ ID NO: 50388 - DNA, 101 bp, rice(Oryza sativa)
  misc_feature (71): n=t or c
aaaatagtgtcgcacgcaagaggaacgttacagagttgatgacgcattatggtctcatcctttaccggtgnaacatcaccattgataccgtcggttacgct

SEQ ID NO: 50389 - DNA, 101 bp, rice(Oryza sativa)
  misc_feature (71): n=t or c
tggcgttgacatctcctagcatcaagaacctttcgcgcacaatggtagccatcgatggactcctgcaatgnctccaaagccctacaagtctagctgtttga

SEQ ID NO: 50390 - DNA, 101 bp, rice(Oryza sativa)
  misc_feature (71): n=t or c
ccctctcttggcactagaaacctctggaaattaccatacgcccatttgttgtttttttattgcatgtgtancttttgatgtgacgcatcctcgtgtgaaaa

SEQ ID NO: 50391 - DNA, 101 bp, rice(Oryza sativa)
  misc_feature (71): n=a or g
aagaagattaatggtctgtgcttgcgccatatttgggccgttcgttctctcctgccaacagaatcaatagnaacttattgtgtggctccatatctttagaa

SEQ ID NO: 50392 - DNA, 101 bp, rice(Oryza sativa)
  misc_feature (71): n=a or g
ttgtttctttctcgaaggcgtcgtctagaaggtccttgttgtatccatttgcccttcagtagcatggtctntttgtagacgtgtggtgtggttcttttttc

SEQ ID NO: 50393 - DNA, 101 bp, rice(Oryza sativa)
  misc_feature (71): n=a or g
tttacattcatcactagagatatgttcgtatatcgagccaacctagctcggctcattatcctaacaagctngaagcctaacttggcttgacccatttgttg

SEQ ID NO: 50394 - DNA, 101 bp, rice(Oryza sativa)
  misc_feature (71): n=a or g
tttttttgttaatcatatctgcagccaccacataatgactagcattgtactcccctgtcctacaatagttnagaggactttatgattaatatactggcagt

SEQ ID NO: 50395 - DNA, 101 bp, rice(Oryza sativa)
  misc_feature (71): n=t or c
aaacaatttaagagctctacatcttgagtgattttccgcttcttcagacgctgcaattttgaaactacttncgtcccataatataagcatctttagagttt

SEQ ID NO: 50396 - DNA, 101 bp, rice(Oryza sativa)
  misc_feature (71): n=t or c
tgttctttttatgtggatccatgttgttgttcttggatgatgcatttttgcatcagaagtggattcctctngtttagtttgatatgattttctcgattata

SEQ ID NO: 50397 - DNA, 101 bp, rice(Oryza sativa)
  misc_feature (71): n=a or g
agatagctggacgactccgtgccatgtcagttgcggcaaatcaggcaaaggcggcatccaaataaacggcncaggtgggaatacttatgggttccagtttg

SEQ ID NO: 50398 - DNA, 101 bp, rice(Oryza sativa)
  misc_feature (71): n=t or c
tatgtatgtacaagatgtatataatcgatccgtatctttgtgtgatgtgtgcccgagccaggggagcatcnagagatcaaagtaagctacgacatatgggt

SEQ ID NO: 50399 - DNA, 101 bp, rice(Oryza sativa)
  misc_feature (71): n=a or g
aaattgtgactatataaatttcaaatctgtaaaatgggctactacataaaacgacatggaagggagaaaangtgggtaagtgatcagtttctccattaaaa

SEQ ID NO: 50400 - DNA, 101 bp, rice(Oryza sativa)
  misc_feature (71): n=t or c
gtgggccccaccattttttttattaatttatgtgtgatactaacaaggtcccatgaagtttattatttttncggatctaattgccacgtatgcgccacgtc

SEQ ID NO: 50401 - DNA, 101 bp, rice(Oryza sativa)
  misc_feature (71): n=t or c
acttattattttaaagataatagttttaaaggcatttggaaaagaagtaattatatacttttatttctccnaatcagagagtgtaagttgatgaatctgtg

SEQ ID NO: 50402 - DNA, 101 bp, rice(Oryza sativa)
  misc_feature (71): n=t or c
agtgccagtgcagacctctctctgcccgtccggtcaccgtcaatctttcagggctgtgtttagttcagcgnaaaatttgaattttagttgaaattagagat

SEQ ID NO: 50403 - DNA, 101 bp, rice(Oryza sativa)
  misc_feature (71): n=a or g
gctacagttcatactttgcacttaaacattcctttcattctaaaatatcacaaccatcagctacaaatatngatatacactcatccaaattcatatttaaa

SEQ ID NO: 50404 - DNA, 101 bp, rice(Oryza sativa)
  misc_feature (71): n=t or c
aatggtatattagcgtcatagcatagtagatagcatgtggtctcgtttatctgctttttggtgagtacatnatctacgcgtttgtatctcagccatcatca

SEQ ID NO: 50405 - DNA, 101 bp, rice(Oryza sativa)
  misc_feature (71): n=t or g
tgtgacataatacaagagatcttttagaccgaaagaattgcaggccacatgatgatatattttcttgttcntttttacaagagtaagagaaataagagaac

SEQ ID NO: 50406 - DNA, 101 bp, rice(Oryza sativa)
  misc_feature (71): n=a or g
tccaaaggaagattgtgaaagagagaaccttgccaagctatacatattacttgcattcattaaagtctaancatggattaattcaatatgtgggtagagtg

SEQ ID NO: 50407 - DNA, 101 bp, rice(Oryza sativa)
  misc_feature (71): n=a or g
ataaaaaaattctcaaacaagtaccatttggcagtttaggaaacgtgcgagctgatgagataaaatcccantttaacttgtcttgttatgacttcgagttt

SEQ ID NO: 50408 - DNA, 101 bp, rice(Oryza sativa)
  misc_feature (71): n=a or g
tctagattttaacactaacaaagatttgatagggtaaccatccaaatacgtagtaatcccttcgctaaaanaagttatgagaattcctgttaaatatatta

SEQ ID NO: 50409 - DNA, 101 bp, rice(Oryza sativa)
  misc_feature (71): n=t or g
gttctctgtcagaaaactagccttaaaaatggacaacactaaaattggtaaaaaaaaatcgtaactccttnatatgaattcctttgtacgaaaattgtagt

SEQ ID NO: 50410 - DNA, 101 bp, rice(Oryza sativa)
  misc_feature (71): n=a or g
ggtggccagctgtatggtatagccaggagccagatgtgaagtattccaaacaattgtcactttcaggaaangcattactacaaagccgatgggtcagcttt

SEQ ID NO: 50411 - DNA, 101 bp, rice(Oryza sativa)
  misc_feature (71): n=a or g
gtaactgtcaaactgaagctaaatgagccctaaattttctatgcaaatacgtatcttcttagataatggtnacttcataagcaaattaatgaaaccatcta

SEQ ID NO: 50412 - DNA, 101 bp, rice(Oryza sativa)
  misc_feature (71): n=t or c
acatcacccctaccaggatcgtatcactattttttcagactgaccgtagacagaccgaagtacaaaacttnaaaacatgaacgcagttagactgaagtaaa

SEQ ID NO: 50413 - DNA, 101 bp, rice(Oryza sativa)
  misc_feature (71): n=a or g
tatacaattcgcttcattacatatcagtacattggatgcagtacacacaagaaaactctacaccggagtcngtagtaaggcgatgtttggacactaattag

SEQ ID NO: 50414 - DNA, 101 bp, rice(Oryza sativa)
  misc_feature (71): n=t or c
caagatcttcggatctgcaacatatcgaagatacaagaaccctatctgcaacacaacaccggttggttatntactgaaagcatcatattcatcaacagaat

SEQ ID NO: 50415 - DNA, 101 bp, rice(Oryza sativa)
  misc_feature (71): n=a or c
ccgttacaaactcctcgcaatctaatgttccatttccatctatgtcaccctggaaaaggaagaaatttgtnagaacattcagcactgcaatgtcaagttac

SEQ ID NO: 50416 - DNA, 101 bp, rice(Oryza sativa)
  misc_feature (71): n=t or c
tgcatgcctctacaagtacaggttgaccagcagggagagtggtgtgtgagcttggcactaacaagtactcnctctcctctgtcctataatataagggattt

SEQ ID NO: 50417 - DNA, 101 bp, rice(Oryza sativa)
  misc_feature (71): n=a or g
tttcgaatcaaacatattagaatcatgtgaattatgccatggactccatgcaagaggtaaggttaaaccgncaagagttaaaatattttgattaacagatg

SEQ ID NO: 50418 - DNA, 101 bp, rice(Oryza sativa)
  misc_feature (71): n=a or g
gtattaattgccttaaccttgtcttaaacaattacatcatgtaagagacctctttgccttaacctttttcncgaatgcgcaacacgtcaatatattagaag

SEQ ID NO: 50419 - DNA, 101 bp, rice(Oryza sativa)
  misc_feature (71): n=a or g
gatcctgggagcaatttaaatcaatggtattatactgtgtttattcatctctcgtctctgtgtttattcanccatgttagggatgtggaacacaattcttc

SEQ ID NO: 50420 - DNA, 101 bp, rice(Oryza sativa)
  misc_feature (71): n=t or c
cacttattataaaatcggcaacaaaattgacattagcaaccaaacacagtagaacgtttaaataaaaaaangcagtagaacgccataggagatctaaacat

SEQ ID NO: 50421 - DNA, 101 bp, rice(Oryza sativa)
  misc_feature (71): n=t or c
catcaataagttattctttgcttgtcccaaatccagtgagatggaaatcctagaaacaaaagggtcgtggnattatcatcccatgaaacagagtatagtgt

SEQ ID NO: 50422 - DNA, 101 bp, rice(Oryza sativa)
  misc_feature (71): n=t or c
caccaatatagttgtactattaactgcatgagtcccaagacatttcagatataatgcaaggtgtatatggntgtgtttagtttagcgcaaagtttagattt

SEQ ID NO: 50423 - DNA, 101 bp, rice(Oryza sativa)
  misc_feature (71): n=t or c
aaaatattgagggggatgaggtggaagtaagtggttatgacaatggtagtgatggtggtgatgataatggnagtggcgatggtgaggatgatgaggcaagt

SEQ ID NO: 50424 - DNA, 101 bp, rice(Oryza sativa)
  misc_feature (71): n=a or c
gctggtgtgctttcagttcatgacacaaatcaactgccagctctctgcgtaatccagtacatgcttgcganaagatgaccttttccagaaggccagcactg

SEQ ID NO: 50425 - DNA, 101 bp, rice(Oryza sativa)
  misc_feature (71): n=t or c
ttactattctttcaattcttttcaccctcatgcaagagtgtttctatgttctagaggctaagtgtcgttgntaagccgttgttaccagtagcaacaattgt

SEQ ID NO: 50426 - DNA, 101 bp, rice(Oryza sativa)
  misc_feature (71): n=a or g
tacaataaaatgcttgtatgtgtactgctggaagaaactttgagccaaccgggagatgatgaacacatatnccgaagtaacagccttctgaactctgaaga

SEQ ID NO: 50427 - DNA, 101 bp, rice(Oryza sativa)
  misc_feature (71): n=a or g
gaatccgtagcttctcagcataagatgtagattattggatgctttcttgtcccagccctgtactatatatncgtacgtacgttcgtgtgccttacatgtca

SEQ ID NO: 50428 - DNA, 101 bp, rice(Oryza sativa)
  misc_feature (71): n=a or c
cacaaaaccacctgttctgatgcatcctggagtgcaagtcccagaatcaatcaaatcactatgacatctanaaaagcaaaggtcagtaagtgatcaacaaa

SEQ ID NO: 50429 - DNA, 101 bp, rice(Oryza sativa)
  misc_feature (71): n=t or c
accgtcagtcgatcatcttgccttcttggggccgccaccaccaccgccggtctaaccacacgttgtattcnggttagaccgtcgggatccagcaaaacaca

SEQ ID NO: 50430 - DNA, 101 bp, rice(Oryza sativa)
  misc_feature (71): n=a or g
aatgattccctaaccctttccagtttctataagcaaaattgtttgcagtgcctttaagatgcgaagaaacngttttgaggatgttgctacatcaatagcac

SEQ ID NO: 50431 - DNA, 101 bp, rice(Oryza sativa)
  misc_feature (71): n=t or c
gagctccctgtatcacacattttcagttacatttctgatgagcctgttgctgcagcttcctttggacaggnaatcatatcttgcaaaacttttcccgttct

SEQ ID NO: 50432 - DNA, 101 bp, rice(Oryza sativa)
  misc_feature (71): n=a or c
gtacactaggttgggataaccattttacaaaggtttagggtgtacatagtcactgctacctatgacgggcnatgaacaggagcctatcaaagataactata

SEQ ID NO: 50433 - DNA, 101 bp, rice(Oryza sativa)
  misc_feature (71): n=t or g
aattagtgtatatatgaaatgtttccatattgctcatatggaaagtttcctaacaagtggcttcacccaanaaggatgcatgcccgatgtactataatttg

SEQ ID NO: 50434 - DNA, 101 bp, rice(Oryza sativa)
  misc_feature (71): n=t or c
agcacaacggaaacccttataaatactccatattactgcaaaggtcggtttgtgcggataacatgtactcnctccgtcctaaaatatagtaacctgtgact

SEQ ID NO: 50435 - DNA, 101 bp, rice(Oryza sativa)
  misc_feature (71): n=a or g
cgagtgagaagtgacttagctaggagtaatattttctagagctggggatgagcgtgttgagtattctctcnatcctaaaataaatatagctgtgtaattca

SEQ ID NO: 50436 - DNA, 101 bp, rice(Oryza sativa)
  misc_feature (71): n=a or c
ctggagtacctttagtacttgatgcgataaagcgcatggcggattaagaggtcctgaatttgatcatcatnagtgagttgggtatcatcatgaggacgagg

SEQ ID NO: 50437 - DNA, 101 bp, rice(Oryza sativa)
  misc_feature (71): n=t or g
gatgaaggatttgtaccttccaacgccatagagatattaagctctatggcatcgatggaatttcaaaaatnatatggatttaagctttctactcaggaaac

SEQ ID NO: 50438 - DNA, 101 bp, rice(Oryza sativa)
  misc_feature (71): n=t or c
tacactaatgagccgctcgttttgtgtgtaagagagattagctaattatttaattaatcatacactaagtngtgttgagctctctatgataaaatgaaata

SEQ ID NO: 50439 - DNA, 101 bp, rice(Oryza sativa)
  misc_feature (71): n=t or c
tggctgatggggattttttttatttttgatacattgttgggtggctgacccagtttagatggcactaaaanccctatcacatcggatgtttggacactaat

SEQ ID NO: 50440 - DNA, 101 bp, rice(Oryza sativa)
  misc_feature (71): n=t or c
ttgagctcatgtgctgaattcctatggaattgtggtataggtatgcataaggaatttggcaacctccaatnctctgttccaaataacctacttaggaaaaa

SEQ ID NO: 50441 - DNA, 101 bp, rice(Oryza sativa)
  misc_feature (71): n=a or g
catctatacggatcactttgccatatacattggtgatgctctaataagaaggagaagaaagacgaagaggnaaaggacttatctatagctccatgcatgct

SEQ ID NO: 50442 - DNA, 101 bp, rice(Oryza sativa)
  misc_feature (71): n=t or c
aaacggtactgcattttatggtagaagttttatatacaaaagttttcttaacaaaccaaacaaatattttnaagattattatacaagtaatttatacataa

SEQ ID NO: 50443 - DNA, 101 bp, rice(Oryza sativa)
  misc_feature (71): n=t or g
gctgaggaattggggaaaaggaaataatgtaagtggcataattctagctctctttgtactaatgactaagntttttagacaacagatccagttggctattg

SEQ ID NO: 50444 - DNA, 101 bp, rice(Oryza sativa)
  misc_feature (71): n=a or c
catggtctgcaaaccccttcttgcatggatgggattcagtaatcatggtctagaggttactgattagcatntctctcgaaagacatgagtactcgatttaa

SEQ ID NO: 50445 - DNA, 101 bp, rice(Oryza sativa)
  misc_feature (71): n=t or c
ttccttgcaagactgatcataagatcgacccatgcaatcacagctgctgatgctgatttacgcattgcctnattgctgccaagtgtcaagttaattaatct

SEQ ID NO: 50446 - DNA, 101 bp, rice(Oryza sativa)
  misc_feature (71): n=t or c
tgcagaatcgtccaagtccaaagacaatgtggaggtgaatcaaggcattgtcggattacatgatattcctnatcgcggtgcgacccaccatactacctggt

SEQ ID NO: 50447 - DNA, 101 bp, rice(Oryza sativa)
  misc_feature (71): n=a or g
attcaaaattccaaagtagtttgtacttttgtagctagagtctgcatgcaggagagagatcatggatacanagctctagttaaccgtacgtacaaagggac

SEQ ID NO: 50448 - DNA, 101 bp, rice(Oryza sativa)
  misc_feature (71): n=a or g
ttgattattttttgtttttcttgagttttctcatgaaacacaaatttgtggatatcccagcaatactttcntaatatctaatgtatcacgttagtggtacc

SEQ ID NO: 50449 - DNA, 101 bp, rice(Oryza sativa)
  misc_feature (71): n=t or c
tttactttgtctttttgtctctatcatatttacattctagttctataagaataggggggcggaaatttctngaaaacctgtcaactaaagcgttgtgtcgg

SEQ ID NO: 50450 - DNA, 101 bp, rice(Oryza sativa)
  misc_feature (71): n=a or g
taaagaaaattcctaatgtttgtgaccaacattgtaagagataaaattaaataattgatatttgtgattgnatgaataagtagctgaagaaaataaaatca

SEQ ID NO: 50451 - DNA, 101 bp, rice(Oryza sativa)
  misc_feature (71): n=t or g
gagttgatttggggaggaagagatgaaagaacatgttgaaggaagaacaaagggggaaagtttagcagctnggggtactttattactttccaatggaaaga

SEQ ID NO: 50452 - DNA, 101 bp, rice(Oryza sativa)
  misc_feature (71): n=t or c
taatacttgttattgtgagagacatgtgcgtgttctaaactcaatgtgcattggcttctaatgttggttgnctgttctttttccaatactgtaacaattat

SEQ ID NO: 50453 - DNA, 101 bp, rice(Oryza sativa)
  misc_feature (71): n=t or c
tgcatagtgacacggtgcttctggtcctgttatctgcagaactcgccttcacagccatggctgcttatccngaggaattgtacagtcaagaaatcagtttt

SEQ ID NO: 50454 - DNA, 101 bp, rice(Oryza sativa)
  misc_feature (71): n=t or g
tttccattcatttttatcagaatttctagcttaatatatttccatcaatacaggaatttctacgattgacngattaaaattatcaagtactccctccgtcc

SEQ ID NO: 50455 - DNA, 101 bp, rice(Oryza sativa)
  misc_feature (71): n=t or g
aggttaaggttcttggcctctcattggtcgtacgggtctgtccattcacaaagactgtacagaaacagtanaaatgagattaatttgaagtttagagtgca

SEQ ID NO: 50456 - DNA, 101 bp, rice(Oryza sativa)
  misc_feature (71): n=a or g
aagaaccagcacctatgaggcatcaaaggtgccaggtcctatccattataggtgccggttatttatagganccggcacctataataccatataggtgccgg

SEQ ID NO: 50457 - DNA, 101 bp, rice(Oryza sativa)
  misc_feature (71): n=t or c
ggggttgtacaaataggatgtgtcacttattagtgatggtgggaagatgtcgacaaccacaatgcacacangtaatgtgcatgtaatgaaaaagtgaagag

SEQ ID NO: 50458 - DNA, 101 bp, rice(Oryza sativa)
  misc_feature (71): n=t or c
gcctagcacgcgttcgtgcccacgctccctcggcttctccatacacccgttgatctcgtgcctaccctaangactagatgacgagttggcatctccttggt

SEQ ID NO: 50459 - DNA, 101 bp, rice(Oryza sativa)
  misc_feature (71): n=t or g
agattttgctttaataaacaacttaaacttgtataagtagaagttttaacttaagtttgtagtgcgctatntatttcatgttggtttatcttattatcgta

SEQ ID NO: 50460 - DNA, 101 bp, rice(Oryza sativa)
  misc_feature (71): n=t or c
gggaatcatctcagtgagagggtgtgtttgacaagaggagaaaaagagaaggtcgaggagatacgtaaaangaagtggatcattagtatataattaattaa

SEQ ID NO: 50461 - DNA, 101 bp, rice(Oryza sativa)
  misc_feature (71): n=a or g
ctaaatagggtctgaaaacattgttatgccacttgtttgaataagagaatcttatcattacagctactctngattaaaagaaaaatggtccatcaattgct

SEQ ID NO: 50462 - DNA, 101 bp, rice(Oryza sativa)
  misc_feature (71): n=a or g
actacctctccccgtatcacaagccaccactctcctcatctcggagagcaagtccttccctttcatcactntcggccgccggtatgtatcacatactgagc

SEQ ID NO: 50463 - DNA, 101 bp, rice(Oryza sativa)
  misc_feature (71): n=t or c
cgaggattataagtcaaaaaaaatagttttagagatcatgccgagtttgaccataccttacattatggaanataggagtaaaataataataataataataa

SEQ ID NO: 50464 - DNA, 101 bp, rice(Oryza sativa)
  misc_feature (71): n=a or g
tgatagcgctacgagggacttaatatctccagccagtgtcgatggcggacttcgctaccctaacagaaacngtaaatctaattgaagaggcctctccaatt

SEQ ID NO: 50465 - DNA, 101 bp, rice(Oryza sativa)
  misc_feature (71): n=t or g
attactgctgttcagcatcagcctagagcttcatatatacctgtgaaattccttccgaggaaaacttgacntaccccaatcccaaacacataagtaaaaga

SEQ ID NO: 50466 - DNA, 101 bp, rice(Oryza sativa)
  misc_feature (71): n=a or g
accggtcctcatactgtagatccgcccctgattggctagcaagatctcaggcatcgttgcgtagagaaggnaagaaggccatccagcacgatagctggttg

SEQ ID NO: 50467 - DNA, 101 bp, rice(Oryza sativa)
  misc_feature (71): n=t or c
tcagctgcacggcagatacatcatagaacatgcgaattcttcagcgaatcagcgggatcaaccgatcaacnggactggcacagggaccatctgatgatggt

SEQ ID NO: 50468 - DNA, 101 bp, rice(Oryza sativa)
  misc_feature (71): n=t or c
tattcagctcaaaactcagctgtcaaaatgcttcctgcaacacagaaactttacaaacatacacatcgctngaataaactgtttctcttttttttttgcgg

SEQ ID NO: 50469 - DNA, 101 bp, rice(Oryza sativa)
  misc_feature (71): n=t or c
aatgatttgaaaaaaatgaatagaggattgtagcaaggttctagccgctccgcagctctactccaaactanggtcctgagttaaatttagaagttagggcc

SEQ ID NO: 50470 - DNA, 101 bp, rice(Oryza sativa)
  misc_feature (71): n=a or g
tgacttgtgtcactgaaagaacgatgaaaatggtcacatggaagattatgtggagcaaagtaaacactcantatcgctagttgaattgaacttacacaatt

SEQ ID NO: 50471 - DNA, 101 bp, rice(Oryza sativa)
  misc_feature (71): n=a or c
ttgtcgttggtgtgtttgcctcctgagaatagctgcggcaaaatgccttggtgctcgtgcagcaccagacncggtctcaccactcgcatagtgaatctacg

SEQ ID NO: 50472 - DNA, 101 bp, rice(Oryza sativa)
  misc_feature (71): n=a or g
accccccttcggtactattcaaaggtgaaggtcatggtgacttgcaggtacgataagtttgtttctattcnttacttggcttcacattgaatccctgactc

SEQ ID NO: 50473 - DNA, 101 bp, rice(Oryza sativa)
  misc_feature (71): n=a or g
catgatgtattttaatatcatttggatatgtctctctctaaatttgtaatacatgaatgtgccaccttcgntactaggttgatttttttataggacaaata

SEQ ID NO: 50474 - DNA, 101 bp, rice(Oryza sativa)
  misc_feature (71): n=t or c
taaattcgctcatcaaatcgatgtactgaatggagaaaacatgtaatagctacgagcattttgagcatgtngcgcatgctagtgccggcaacttcagggcg

SEQ ID NO: 50475 - DNA, 101 bp, rice(Oryza sativa)
  misc_feature (71): n=t or c
ttctcaacagctgcttttgtaattgttgtggttagttctctggaatttgcagctatttgagaaaaaaaaantctcatataatgttttaaatagcttttgtt

SEQ ID NO: 50476 - DNA, 101 bp, rice(Oryza sativa)
  misc_feature (71): n=t or c
acccttgcttgccttagcggattgcctctattatgcgatcggtttgaaatttctgtaacattgctgcaccnaggacagtcttcaatagacgacagcctcat

SEQ ID NO: 50477 - DNA, 101 bp, rice(Oryza sativa)
  misc_feature (71): n=t or c
ccggttggtaacgggacgaaagatcatcttttgtaccggtttattcattgtcacgacgtggcaggtccccnactatttttaatcccagttggtataaacaa

SEQ ID NO: 50478 - DNA, 101 bp, rice(Oryza sativa)
  misc_feature (71): n=t or c
tgaggttagttctttgcaagctacaaatgtcatatatgtgactgaatattctagaatttagatgatattgnaggcttgagtgagttaatttaaatagccaa

SEQ ID NO: 50479 - DNA, 101 bp, rice(Oryza sativa)
  misc_feature (71): n=t or c
gtagagaataagggggcgccctttaacaggagctgccagtacaggaggattaagcaagtacctcttgatantatcgaagccattttggcattcttcatccc

SEQ ID NO: 50480 - DNA, 101 bp, rice(Oryza sativa)
  misc_feature (71): n=t or c
aagggtggggcaactagagatgaaaatggtcaaaaatgattttttttttcctcataaacgatttcagcacngttagaagatttctgtatttacaaagtgca

SEQ ID NO: 50481 - DNA, 101 bp, rice(Oryza sativa)
  misc_feature (71): n=t or c
accccttttgtctcatcgtctttggggatggaaccccttgaaggtcacacagcttcgctccccaaaccctngaatctcacccgctgcccccgaccgaactc

SEQ ID NO: 50482 - DNA, 101 bp, rice(Oryza sativa)
  misc_feature (71): n=a or g
tttaaaaaaactgaaaatattaccacacgtgataactacgataaccatgtatttttttgggaaccccgcancacaaccgtcacaacgtcccccacgcgctc

SEQ ID NO: 50483 - DNA, 101 bp, rice(Oryza sativa)
  misc_feature (71): n=a or g
tgtacgtggttacatgctaagcactatatttgttttgtggattgatgaaacgagatagtaggaggtgaaangacagcttttaaaatacatggaactggtca

SEQ ID NO: 50484 - DNA, 101 bp, rice(Oryza sativa)
  misc_feature (71): n=a or g
ttcttctttctcgatggtgatcgtgtatatttgaatattgaaacaaagttacgtgtatcaacaatatttantaacaacatattaaacatataataaaagtt

SEQ ID NO: 50485 - DNA, 101 bp, rice(Oryza sativa)
  misc_feature (71): n=t or c
taggaattcatttattttggaacatcggtaagtaacaccaatcgtgtgctatattatttttattgtgaaanatagtatagacatagacattcatataccgt

SEQ ID NO: 50486 - DNA, 101 bp, rice(Oryza sativa)
  misc_feature (71): n=a or g
atggccatccctctaagtccggtattcttacccaaaccctcaccccttgccccacacccatcccaacccgngaccctaaatcctaactgcattgtcttcgt

SEQ ID NO: 50487 - DNA, 101 bp, rice(Oryza sativa)
  misc_feature (71): n=a or c
ttcgggtcataatagtgtagacaacatacctatcaacagcgagcgggaaaaaaaagaaaataagcgagcanaataatctcgtttgctcacctcacctgcgc

SEQ ID NO: 50488 - DNA, 101 bp, rice(Oryza sativa)
  misc_feature (71): n=t or c
gagcagagtgaatgaaccgacggtcacgcgcgcatcacgaggcctcgatcgtcgcctcaatcacaccgcangccaccctccttgctaatcgcatcactcgc

SEQ ID NO: 50489 - DNA, 101 bp, rice(Oryza sativa)
  misc_feature (71): n=a or g
cggtgccccgccagttggacggccacacccgaacaagcacaaaatgaagatctctcaaggtgaaacaacancactcctcaagaaaatcttgactaaactcg

SEQ ID NO: 50490 - DNA, 101 bp, rice(Oryza sativa)
  misc_feature (71): n=t or c
atgattaggagaaagacgacgagtagatggtgagaggttgtgacttgtgaaaattgatactccctctggtnctatattaacgttttggacaaggttgagat

SEQ ID NO: 50491 - DNA, 101 bp, rice(Oryza sativa)
  misc_feature (71): n=t or g
ttttttccataaataagatctctgcaaggtagaattaattatctgtgtccttgtcccacgtgtcaccacgngaagaacttgtctaaaatcaccaccaaata

SEQ ID NO: 50492 - DNA, 101 bp, rice(Oryza sativa)
  misc_feature (71): n=t or c
ctcccatgctaaacccagcctggacgaggcatacgagccaggctgagagcattcgagcaaccaaacacacncgtcccttcttctccttccgctcgtctcgc

SEQ ID NO: 50493 - DNA, 101 bp, rice(Oryza sativa)
  misc_feature (71): n=a or g
gacgcccattggaacacagtccaccaaatctgcttaccaccaacccgagttcaatgggaacgtgcatgatntagtgacccatgaactcagtaatggcctct

SEQ ID NO: 50494 - DNA, 101 bp, rice(Oryza sativa)
  misc_feature (71): n=t or g
cagtaatatttctatatattcatagctcaacctgaaccattataatctagacccactacgatctaacggtntagatatttctttttttcttcgattaatgt

SEQ ID NO: 50495 - DNA, 101 bp, rice(Oryza sativa)
  misc_feature (71): n=a or g
aggaggcactaactcgccgtggagatacggagagtgtggagacaggtgggtcccactgttttttccgactngtatgtggtccctacattttttaaaaatct

SEQ ID NO: 50496 - DNA, 101 bp, rice(Oryza sativa)
  misc_feature (71): n=t or c
tattaaggaggcaacggtaacgatagaaacactctttttagtttaacgattcttagaaataacttgtatgntataaggaagtaactttcatatgttttaaa

SEQ ID NO: 50497 - DNA, 101 bp, rice(Oryza sativa)
  misc_feature (71): n=a or g
agtgttgatgaaggaaattctcctatggaacgttggcaggcgaaaattcgtcgatttagacaacatctcangggttgggctaaacatacaagtggtttgca

SEQ ID NO: 50498 - DNA, 101 bp, rice(Oryza sativa)
  misc_feature (71): n=t or g
tagaaatcgtgtgccagcgggagatacaaaattcactggttttattatcaatccacaggtggagatacctngggggggtgatcatcaccacctgcacctca

SEQ ID NO: 50499 - DNA, 101 bp, rice(Oryza sativa)
  misc_feature (71): n=a or g
aactagccctcccgaacaggatttactggttgccccagttcccaactcccaactccccctcttgttttccncgcgcacgcttttcaaactgctaaacggtg

SEQ ID NO: 50500 - DNA, 101 bp, rice(Oryza sativa)
  misc_feature (71): n=t or c
attataattttatctactacgggtgcacaatatgtggggtaaacttacaccgatataagtatttcatgtgnatatgatgagagagtctagaacctgtcaaa

SEQ ID NO: 50501 - DNA, 101 bp, rice(Oryza sativa)
  misc_feature (71): n=a or g
atcctgtttgtgaccttcgaagtggacgtgtcgacataagtgcacaagtttgttcctgacctgacttcttnctgttttgatactgaatgcgattcatgttt

SEQ ID NO: 50502 - DNA, 101 bp, rice(Oryza sativa)
  misc_feature (71): n=t or g
atatgaaatcacgaaatgcgttagaagcgtttgttttatttattaatccgaacctctttgtttgatgcacntgtcactcttggaactctatgtgaaaaatg

SEQ ID NO: 50503 - DNA, 101 bp, rice(Oryza sativa)
  misc_feature (71): n=t or c
ctaatcaattccaaatttccaatcccaattaaatgagctcggaggcaaggagtaggggctgcgcgtgcganggcggtgactagcaagcacgtgcgaggcgg

SEQ ID NO: 50504 - DNA, 101 bp, rice(Oryza sativa)
  misc_feature (71): n=a or g
attacttctgactgctgtcatggctattttgttttatcttgtgtttgcagtattaccatatctgatatctntttgtatttttcatatgataatcatttgtt

SEQ ID NO: 50505 - DNA, 101 bp, rice(Oryza sativa)
  misc_feature (71): n=a or g
gtgacaagatatcctagaatcttcctaccaccaccaccaccacacgcactactactgcaattgcatgcacntatactatctcttttcaccacacatccaat

SEQ ID NO: 50506 - DNA, 101 bp, rice(Oryza sativa)
  misc_feature (71): n=a or g
agacacttgtccccttccttttccttctgcccttgttaattgaatgttgtccatcttatcaataaatgagntatcgatccaaattgcgtatcgagaaacaa

SEQ ID NO: 50507 - DNA, 101 bp, rice(Oryza sativa)
  misc_feature (71): n=t or g
atagtactttttattaaaataatgaacaaaatattccaaaaattataagtaaggcttgacatagaaaacanaatattttttctgatcctaaaatgagatat

SEQ ID NO: 50508 - DNA, 101 bp, rice(Oryza sativa)
  misc_feature (71): n=a or g
ggcctgggctgtctgatgaatgcggagtaggcaacggggccggcctatcaccaaggaccgaacttttttcntttttagattttttttaatatttacagaaa

SEQ ID NO: 50509 - DNA, 101 bp, rice(Oryza sativa)
  misc_feature (71): n=t or g
agccaaatttatcaaattttaagcccaaattgttgaaattgtctaaaatatatcaagctatgccatattcnttacaaatatgtttaaaatgtccaaacaaa

SEQ ID NO: 50510 - DNA, 101 bp, rice(Oryza sativa)
  misc_feature (71): n=a or c
aaggcttaagaccccccttatggtatacattgtagatgcttactatctatatatcatttgacaaaaaaaanccttagaaaaatcttgtaaattttggatca

SEQ ID NO: 50511 - DNA, 101 bp, rice(Oryza sativa)
  misc_feature (71): n=t or c
ggaattcctagaggcggggggctggtaatcttgaacatgctgctagcgcattagggcagtcccaaccctcnatctaggatggtgtctatggcattaactac

SEQ ID NO: 50512 - DNA, 101 bp, rice(Oryza sativa)
  misc_feature (71): n=t or g
tttcaattttggctgatgtgttcctatacatgtagctaggcagaaaaaaaaacctattaaattatcaacanatatatatatatagtggtgtcactaaatta

SEQ ID NO: 50513 - DNA, 101 bp, rice(Oryza sativa)
  misc_feature (71): n=t or c
tatgcccgaagaagatctcgaggtggaaatgattgctaagagctttatctcccagcgggaatggctagaangcaaccagggatgatggagacacggtgtgg

SEQ ID NO: 50514 - DNA, 101 bp, rice(Oryza sativa)
  misc_feature (71): n=t or c
gagcgggatgatggggaggcgccaagccacagagaccatgctgttgcccccgttcccaattacctctcatnttccgcgcacgcttttaaattgctaaatgg

SEQ ID NO: 50515 - DNA, 101 bp, rice(Oryza sativa)
  misc_feature (71): n=t or c
tgatgtagtcgtgatgctttgttaaatccttgatgtaaggagattggatctaagcgcatgacttttggttntgtacatccattcaaagaaaaactcttttt

SEQ ID NO: 50516 - DNA, 101 bp, rice(Oryza sativa)
  misc_feature (71): n=a or c
ttataattatgcattcacgcggtaacttgtaaagcatccatggatgcgtgtagttgctgtacaatttgttnattaccatgattgaattgagtagcatgttt

SEQ ID NO: 50517 - DNA, 101 bp, rice(Oryza sativa)
  misc_feature (71): n=t or g
caagatcgctcaagcctcgagacgtcgttgcgggagatatctgttcgctattgttgatcacgaaaacttcncctggtccggtcaactacggagactctcac

SEQ ID NO: 50518 - DNA, 101 bp, rice(Oryza sativa)
  misc_feature (71): n=t or c
aaactataacaacctgttgaatcaacttctacatgagttaggacttatcaagaatatctgttttttttttngaacgtgcaaaaggattgcacgtcaatata

SEQ ID NO: 50519 - DNA, 101 bp, rice(Oryza sativa)
  misc_feature (71): n=t or c
aactaaactgggccttagctaaaactgtacaacagagtctaaacctacacaagagtctcaagactaagggnctgttcactttaatgccattttcaaccata

SEQ ID NO: 50520 - DNA, 101 bp, rice(Oryza sativa)
  misc_feature (71): n=t or c
gaagaagagatcagaattcagacagacatggaaacaaagattgggagaaaggaaggaatagctaagccagnaacctttttaatataattttcttctaaaca

SEQ ID NO: 50521 - DNA, 101 bp, rice(Oryza sativa)
  misc_feature (71): n=a or c
gacacgacaggatatatgtagcatctatcatatcattacacaaagaactattgaagcctggaggatcaagnaaaaaaaaacatgagaactctgtgttgcac

SEQ ID NO: 50522 - DNA, 101 bp, rice(Oryza sativa)
  misc_feature (71): n=a or g
acgtgtggtcccagctctcgcatgcagcagcgcaagtgcacacatcgtggcgtccagtgtactacgtactnctacctccgtatcaggttatacgactttct

SEQ ID NO: 50523 - DNA, 101 bp, rice(Oryza sativa)
  misc_feature (71): n=t or c
taattagactgaagaactggtgagcagccaatctttcgcaaaagctaatcctaccaattgttctcgtgtanaccgtaggctgctgagtggatttctgaagt

SEQ ID NO: 50524 - DNA, 101 bp, rice(Oryza sativa)
  misc_feature (71): n=a or c
aaattaaataagacgaatggtcaaacacatttattaaaaattcaacgacgtttgtcagggttatggatacnacatacctaatagtagttgactaaatctcg

SEQ ID NO: 50525 - DNA, 101 bp, rice(Oryza sativa)
  misc_feature (71): n=a or g
ggaatcaagaaaaaagatcacttatccttttctaaatggggccttattgttaacttgttccagaacagctncgaaaatctgtacattttttcaatttcgtc

SEQ ID NO: 50526 - DNA, 101 bp, rice(Oryza sativa)
  misc_feature (71): n=a or g
cggtcaggtcggaggtgggtaaaatggacatcggaggaatgaaaaaggagaaaaggcccgtgggctgcccngccaggaaggcccgtgggctgcccggccta

SEQ ID NO: 50527 - DNA, 101 bp, rice(Oryza sativa)
  misc_feature (71): n=a or g
accatgaaacatatatagctaaattaagcgtacacttcgtaaacaagaataactaactgaaacatgaatcntaaaagccgctgcataaaacatcgagttcc

SEQ ID NO: 50528 - DNA, 101 bp, rice(Oryza sativa)
  misc_feature (71): n=a or g
ttcctcgtccaaactaaagaaacaattaagctccatcggagacggtcattatctatagagtaaagtgcacnggcggtctctaaacttgtgtgggtgtgtca

SEQ ID NO: 50529 - DNA, 101 bp, rice(Oryza sativa)
  misc_feature (71): n=t or g
atttattctctattctttataaactttgatgtaatgactgctaaaaatgaatttatttgaaaacaaccgtnagaggttaaggccctgttttctttcagctt

SEQ ID NO: 50530 - DNA, 101 bp, rice(Oryza sativa)
  misc_feature (71): n=a or g
ttatctccgccctaggttttaatctagcgtcgccgttgtctccacgtgttgccgccggaccattgtcgtcntctcctcctcgccgatcgtctcggtttggt

SEQ ID NO: 50531 - DNA, 101 bp, rice(Oryza sativa)
  misc_feature (71): n=a or g
attcgactagaggagaaacggagccatagtgctaggtcctcaccaatgtatggctgcctaggtatggcctnaccgttggaccatgcctaggcctttttctc

SEQ ID NO: 50532 - DNA, 101 bp, rice(Oryza sativa)
  misc_feature (71): n=t or c
ctctgtcatcactcatcagcctgtagccaatgtgatgagagttcaatgtatgtagtacaaaattcaacccnatcttcctttttttgtgactgacttgcaaa

SEQ ID NO: 50533 - DNA, 101 bp, rice(Oryza sativa)
  misc_feature (71): n=a or g
aggaagaacaatcgattgctagagatgattcgctaccaaaggaagacatgaccatcaacatggtgtgtatnttgcctatggagttttgtgctacagatgaa

SEQ ID NO: 50534 - DNA, 101 bp, rice(Oryza sativa)
  misc_feature (71): n=t or g
caaccaaatgagagagataaattcgaagtaaattttgcaagaagtcggagctcttcaaaggggtccttagngagttttgtttgactttttgtcactctact

SEQ ID NO: 50535 - DNA, 101 bp, rice(Oryza sativa)
  misc_feature (71): n=t or c
ggtcgagtaccgggggatgatggtggggagaggcacagtggtagcctccaggagagagaagccatcgtggncggaggggggatggcgcagatagtggtaac

SEQ ID NO: 50536 - DNA, 101 bp, rice(Oryza sativa)
  misc_feature (71): n=t or c
tcctccccgtctcctctcctccatcggctctccttgacgatcggtgatgggagcggctagtgggctgtgangggaagggtggtccgccactcggaggccta

SEQ ID NO: 50537 - DNA, 101 bp, rice(Oryza sativa)
  misc_feature (71): n=a or g
cttgctagattcttaaaacatgaatataaattatattgctctgctcgcagtattcaccttattctccatgncagcagggcctccttctcatacaggtgcat

SEQ ID NO: 50538 - DNA, 101 bp, rice(Oryza sativa)
  misc_feature (71): n=t or c
attcagtcctatgaattattgttgctctgtgacgtttgttgttgcctgcctgggctggatagatagtactncatcatttttaaaatatactttctgtcctt

SEQ ID NO: 50539 - DNA, 101 bp, rice(Oryza sativa)
  misc_feature (71): n=a or g
gcttctccccgaactggtgcgccgggatgctcacgttgctaccgtgttcctccttgctcatcacgccgacnacgtcgcgcgcgcgggcacggctgcggcta

SEQ ID NO: 50540 - DNA, 101 bp, rice(Oryza sativa)
  misc_feature (71): n=a or g
aaaacaaccacttcattcgtcctaaaatataatagcttatgatcggataagatacatcgtaatactataantctagatagagatatgtctagatttatagt

SEQ ID NO: 50541 - DNA, 101 bp, rice(Oryza sativa)
  misc_feature (71): n=t or c
tggccgcggctggctgacagaagagagtgagcacacagcgggcagactgcatctgaattacctgttgcgangaagaagacgacggacgcagcttgccgttg

SEQ ID NO: 50542 - DNA, 101 bp, rice(Oryza sativa)
  misc_feature (71): n=a or g
caccaaaaattttataatagtagagatttagacaaacctgttaaactggtaaaaaggtcagctcgacccanctcgacccaactgtgacgtcgaccatttaa

SEQ ID NO: 50543 - DNA, 101 bp, rice(Oryza sativa)
  misc_feature (71): n=t or c
cgtacggcaccacgccggggccctgccggttctttcgctccggatccttgttccggcagtcgatcatctcngcgatgctcatcatcctctcgttgaacctc

SEQ ID NO: 50544 - DNA, 101 bp, rice(Oryza sativa)
  misc_feature (71): n=t or g
atatgtaatggtaatattttatctaataaataggctatttgctcaacgagctttatcgaaagctttggtcnttttagttgttgaataacgtacatatatta

SEQ ID NO: 50545 - DNA, 101 bp, rice(Oryza sativa)
  misc_feature (71): n=t or g
agcaatctacaacttcactgtagtatctcaatttgattatattttagtagcaaacctttttttttcgaacntgcaaaaggattgcacgtcaatatattagc

SEQ ID NO: 50546 - DNA, 101 bp, rice(Oryza sativa)
  misc_feature (71): n=a or g
aaagcctaaagcaccaaatgatgtatgctttgtctcatggttgaaaggattggggtcaagatgtcagatgnagatgaaatattactattatttgacaccga

SEQ ID NO: 50547 - DNA, 101 bp, rice(Oryza sativa)
  misc_feature (71): n=a or c
atataataaaaaagggctgtattgttatgacagaatggcccatttaatttggtatatagtctggaaaggtnaaaattttagtattgtaaaatattgaaaag

SEQ ID NO: 50548 - DNA, 101 bp, rice(Oryza sativa)
  misc_feature (71): n=t or c
gttgtagatccatgtcgatgatgggaaacaagtgataatcatagcttgtttctgaatatgccatgtatatnctggacaatgcatagccgcgtgctggcatg

SEQ ID NO: 50549 - DNA, 101 bp, rice(Oryza sativa)
  misc_feature (71): n=a or g
cacgggccacccaaaccaaaagcagcgcgcagacgcagagctacacaagaaaccttgagccaatagagcancgaagcggccatgtcacgcctctgccacca

SEQ ID NO: 50550 - DNA, 101 bp, rice(Oryza sativa)
  misc_feature (71): n=t or g
ggagggcgagccgcgaaggcgtatcgggaagaaatgaatcgagtcgtcggcgcggaggtgaacctgggaanaatgacacccccggcgagcggaggcggcgg

SEQ ID NO: 50551 - DNA, 101 bp, rice(Oryza sativa)
  misc_feature (71): n=a or c
tgcgttggagtttggggggaggaaagtggggaggaggaggtggtattaataggggaggcgggaggtgcggnggggccagcgggaggggaggtttgacccca

SEQ ID NO: 50552 - DNA, 101 bp, rice(Oryza sativa)
  misc_feature (71): n=a or g
ccctgacttcatcaaagaggaagcagaacccggtgagattctcgaacttccaatcttggaacctccgcttnagcttaaacctctacctgaaggcctacgat

SEQ ID NO: 50553 - DNA, 101 bp, rice(Oryza sativa)
  misc_feature (71): n=a or c
gggggcagtgcgtcgcggcgcggggggacgggtagctaaggtttaatttgctaccgatcagggcgcggcanactgaagccgggaagcgaccgatcgagatc

SEQ ID NO: 50554 - DNA, 101 bp, rice(Oryza sativa)
  misc_feature (71): n=a or g
gtgtggccatttttttttcaaagtttagcatcagtatttttatgatgcctagactgaatttatgaagacantacatgtagatttgttgtgaaaagtacttc

SEQ ID NO: 50555 - DNA, 101 bp, rice(Oryza sativa)
  misc_feature (71): n=t or c
gaaatgaagtatggtggatagtcttatctaatcttaccatttgcagtttactcatattgctaaacatgganggtggcctatgtaacgtctactagacactc

SEQ ID NO: 50556 - DNA, 101 bp, rice(Oryza sativa)
  misc_feature (71): n=t or g
cgggctaggtcatcaaggccatcgataagaaacgccgcactttcctatggatgggcacggacaaggtccangggccggggaggggtgccttgtttcttgga

SEQ ID NO: 50557 - DNA, 101 bp, rice(Oryza sativa)
  misc_feature (71): n=t or c
tgtcttttacttgtttcaggcgttggtatgctatctttaatttagtactgttcacaaccttgtcgaattanctgctctgcaaaattacaaaaactttatga

SEQ ID NO: 50558 - DNA, 101 bp, rice(Oryza sativa)
  misc_feature (71): n=a or c
agccggcgataatcgattttcattggcggtaccactactgcagatttgattttttttctatacaaaacccncaataggttgtaggcagcccataagtgctc

SEQ ID NO: 50559 - DNA, 101 bp, rice(Oryza sativa)
  misc_feature (71): n=t or g
gtcttgcttaaggtggagaaaaaaaaaagtgagaaattagaattcagaagtggaggaggaaaataaaaaanaaaattgagaaatggagatgcggggtatcg

SEQ ID NO: 50560 - DNA, 101 bp, rice(Oryza sativa)
  misc_feature (71): n=a or g
aggacttccatccacattttcatatgcggacaccctaagagacttgcttgcaaaagcaaatttcgtatgcngaacccttaagtcactagcctgcgaaaagg

SEQ ID NO: 50561 - DNA, 101 bp, rice(Oryza sativa)
  misc_feature (71): n=a or g
cacagtacagaacaaaataaaaaggttataagtacaaaaacttgtgcactcaatccaagtatccaactgantaccctaccgtgaaataatgcagaataaat

SEQ ID NO: 50562 - DNA, 101 bp, rice(Oryza sativa)
  misc_feature (71): n=t or c
taagaaatatttaaatcttccagcttgtatgatagacaaacaaatacacacgggcttacattgttcgtgcntagtttttttagaggagatgtatcgatcag

SEQ ID NO: 50563 - DNA, 101 bp, rice(Oryza sativa)
  misc_feature (71): n=t or c
tgggaaaaggaggtgccgaacaaacccttagaaggtaacctatgagtcaattcgtgggttatgcactagtnttgtttataagcgggttcgccgcttagctc

SEQ ID NO: 50564 - DNA, 101 bp, rice(Oryza sativa)
  misc_feature (71): n=a or g
agtccctagatccaaacaggccttaggctgtgttcgctcctcctggatgggaacactccccctccatcacngaaaacggagcagtccattagcgcgtgatt

SEQ ID NO: 50565 - DNA, 101 bp, rice(Oryza sativa)
  misc_feature (71): n=a or g
taatatgtgaacagaaatatgtcgaagttgcttacccaaagtagtacgggaccatgatgactcgtttgtcngagtgtgcgagaaatgaggtggccaagtaa

SEQ ID NO: 50566 - DNA, 101 bp, rice(Oryza sativa)
  misc_feature (71): n=t or c
tataccaaataccttctaaaagaaagcctaaaatgccctaatatacgtgtaagagttgacaattggttgancactggaagattcaaaaagctgtgaatttt

SEQ ID NO: 50567 - DNA, 101 bp, rice(Oryza sativa)
  misc_feature (71): n=a or g
ggaagcatgatgtattactgtgtaccagtatatatagcaatataagcaactagatgaaaccccgcgcgttnctgcgggatttaagtatgataacaataaat

SEQ ID NO: 50568 - DNA, 101 bp, rice(Oryza sativa)
  misc_feature (71): n=t or g
gcgcactacttgacagttcgtattttgagggaaggagagagattgccgctgaaattttctatgacccgttnctgacaggattgattggacttcaaattaaa

SEQ ID NO: 50569 - DNA, 101 bp, rice(Oryza sativa)
  misc_feature (71): n=t or c
aaccaaaaaaccagaaaaggaatcaactctagccttatttgctaaaaaatggctaacacaattttgactanggaaaacttattaactgcttaaatattgta

SEQ ID NO: 50570 - DNA, 101 bp, rice(Oryza sativa)
  misc_feature (71): n=a or c
gtatgtgaccctccctgaaaaaaacagtgtatgtgagtcgcagatgatgcaatatttaggcaagtgtctanaatatttgcattgttttgtttggccttaac

SEQ ID NO: 50571 - DNA, 101 bp, rice(Oryza sativa)
  misc_feature (71): n=t or c
gtggtggcaaagggcagggtggcggaatggggactgtggtagggctcgattgtggcaatgacgtaggggangaggcagctcgatccaaatcaagtggcctc

SEQ ID NO: 50572 - DNA, 101 bp, rice(Oryza sativa)
  misc_feature (71): n=t or c
aataccaatagtaatgtatattgctaaatcacttttcaatggtgaggttctacaagggcatttctaatgcntatgaacctaggtggtatcagggtttacct

SEQ ID NO: 50573 - DNA, 101 bp, rice(Oryza sativa)
  misc_feature (71): n=a or g
acctaatatagtctcggttagtttggcagaaaggagttctcacacgtagccgatggctagcgtagtcttcntcctcgaatatgaactcgatgagactgaag

SEQ ID NO: 50574 - DNA, 101 bp, rice(Oryza sativa)
  misc_feature (71): n=t or c
ttgacgctgtagccacccataccgtcgtagaacaaaccgtatggtgcacatctacccctgtccatcacttncatgaacgctgcctagcttatcctccaaac

SEQ ID NO: 50575 - DNA, 101 bp, rice(Oryza sativa)
  misc_feature (71): n=t or c
agtaggaagcccagcgtccctcgcccagttgacagtggctttaaccggtgatgcatgtccggatcggtccncccaatgcgcgtgagcccacgaagtcacca

SEQ ID NO: 50576 - DNA, 101 bp, rice(Oryza sativa)
  misc_feature (71): n=a or c
acatatgaaacaacatgtattaactgactgaaacatatgctttcttttatcaaaaataatcatgcgatatnttgttctaaagatttaattacaacgaatac

SEQ ID NO: 50577 - DNA, 101 bp, rice(Oryza sativa)
  misc_feature (71): n=a or g
aaagaaaggtaagtgagctgaagcatgctagcttgttgtggtagtggctcaagtggagacttcaaccttancaagattttttcaacattgccatctattgc

SEQ ID NO: 50578 - DNA, 101 bp, rice(Oryza sativa)
  misc_feature (71): n=a or g
acatataaatcatcatacatcaaagtagcagttaaacaaagttaacaccattgaattatcatatataaaanataggaacaattttgtttttaccactagtt

SEQ ID NO: 50579 - DNA, 101 bp, rice(Oryza sativa)
  misc_feature (71): n=a or c
gaatttttcgcaggcacaacacaaacgatccttttgtgttctgcacttgtgctagctagaactgctactantacatccaacaagctagtgaagattgtttg

SEQ ID NO: 50580 - DNA, 101 bp, rice(Oryza sativa)
  misc_feature (71): n=t or c
taggtgcgtttggttcactgtcaaaagtggatgtgatatggccgctcatattttgctggatatggtgattnaattttttgtttggttggatggatatggtg

SEQ ID NO: 50581 - DNA, 101 bp, rice(Oryza sativa)
  misc_feature (71): n=a or c
gaacatctgatattgtagagtttctttgcgagtaatcctgatactatcaaaataaatttaatcagggagtngaacttacaaccaagaattttcgaactgaa

SEQ ID NO: 50582 - DNA, 101 bp, rice(Oryza sativa)
  misc_feature (71): n=t or c
ttttataagtgatttgctcccgtccagcagaggtaggcgtaccaaatcctagccgtcaattgggacatatnagacggtgattgagatttctcggtaccgtg

SEQ ID NO: 50583 - DNA, 101 bp, rice(Oryza sativa)
  misc_feature (71): n=t or c
ttctgtaagtgtttatctgtacaatatttatctgttgatctcctcttcttatatcacctcatcttgaaggnagtcctattgtccctttacgctattctgac

SEQ ID NO: 50584 - DNA, 101 bp, rice(Oryza sativa)
  misc_feature (71): n=a or g
gtcatcccccctctccccatattttcttcctttcagttgctctgctgttcgccccagtgctcctctctctncactggtggtgtggtgaagttggaggtggt

SEQ ID NO: 50585 - DNA, 101 bp, rice(Oryza sativa)
  misc_feature (71): n=t or c
acacctttggtgtcggttgggaaccggccataggtgcctgatttcccaaccagcaactagtaggtggcacngatgacttcggttacaggtgtcggttgtag

SEQ ID NO: 50586 - DNA, 101 bp, rice(Oryza sativa)
  misc_feature (71): n=t or c
gagagttgcaattctccacggtgcatcatcgatcatcaattactgctgctgctgctgccaggtaacccagnagaacactactactacgagctggtacaata

SEQ ID NO: 50587 - DNA, 101 bp, rice(Oryza sativa)
  misc_feature (71): n=t or c
tgtcaataatgagttagtggacaaatctataagacttccacataacttagttcactgcttctatgaaattnatgcgcatagaagagcttggggttcatgtg

SEQ ID NO: 50588 - DNA, 101 bp, rice(Oryza sativa)
  misc_feature (71): n=t or c
tgattccattggactttaaacaactttattaccttagtgcgagttgttctttgtgcttcatccaaaatagnagcatacaacataaagagtctcatgaaaga

SEQ ID NO: 50589 - DNA, 101 bp, rice(Oryza sativa)
  misc_feature (71): n=a or c
acatgttgcgtaagttacttgcgagaaagtgtttgaggttagataaatatctattattaaaaggaaaaacnttttaggttatcttttaaaagacgatgaag

SEQ ID NO: 50590 - DNA, 101 bp, rice(Oryza sativa)
  misc_feature (71): n=t or c
aatcacgcctaaatccttgtaaactgtcatggaatatattttgaaaaatcaatttcctactccctcagttnctaaatatttgacgccattgacttttttaa

SEQ ID NO: 50591 - DNA, 101 bp, rice(Oryza sativa)
  misc_feature (71): n=a or g
tagtgcaaaaacttaaaaaatatgcaaactggtacatgaacttggcaatcaagtgcattttggtcaaaacnctgttacatacatatgattcaacctatttt

SEQ ID NO: 50592 - DNA, 101 bp, rice(Oryza sativa)
  misc_feature (71): n=t or c
agccattatctcaccgtgattttgacgccacgcgatggaacaaattaattaaataaatcactctcctcaanagaacataaacaaattctatcttttgaatt

SEQ ID NO: 50593 - DNA, 101 bp, rice(Oryza sativa)
  misc_feature (71): n=t or c
atataaaacgtaacctacatgcctattcctcctacaaagtaacatatgcatgtctgccatgtccgactctntgactctcatcctgtagtatatgtaattga

SEQ ID NO: 50594 - DNA, 101 bp, rice(Oryza sativa)
  misc_feature (71): n=t or c
ctgaaatttgaataataaggactccctcctttcaaaaatataaccaacttctaaaactcaaattttattcnaaatatagcaatcaaatacttgtaaaagtt

SEQ ID NO: 50595 - DNA, 101 bp, rice(Oryza sativa)
  misc_feature (71): n=t or c
gaacatgtatctgatttttgcaactgattgtgatgtcatgtagtgcatataaaagaaaaaagagggaaacnaaatgtggttcagttcagatttggctctgt

SEQ ID NO: 50596 - DNA, 101 bp, rice(Oryza sativa)
  misc_feature (71): n=t or c
ttcaaacgcctatgtcgcaggacgatatgggacgaaactcacccgtggaaatgggcatggcgatgacctcngtaggttggtgatctttgttttcatctcct

SEQ ID NO: 50597 - DNA, 101 bp, rice(Oryza sativa)
  misc_feature (71): n=a or c
aaaaaaaggactgagaagaatcaattttcctaaaatatccacctacagcacaacatttacaatcacatagnaatcttttttttttcaaaaaaaaaaactaa

SEQ ID NO: 50598 - DNA, 101 bp, rice(Oryza sativa)
  misc_feature (71): n=t or c
gagcatcttaaagctaaaagccatcaaataaaggccgttcttccattatgctcactccatcccagcatatntgcatatgcttgtattaactgcagagacaa

SEQ ID NO: 50599 - DNA, 101 bp, rice(Oryza sativa)
  misc_feature (71): n=a or c
tgtgtccttcgttagatatcatatcgctgcgccttatatagcctcacgaacgggctcagtcatgatctcgnacgcgactaggattactcgcgatctcgcga

SEQ ID NO: 50600 - DNA, 101 bp, rice(Oryza sativa)
  misc_feature (71): n=t or g
gggctttgtgggggctcccatggtccacgcgccagttgtggagtctcaagaccctgccatccccatgctanatccgccctgcctagagggtgagcgcggct

SEQ ID NO: 50601 - DNA, 101 bp, rice(Oryza sativa)
  misc_feature (71): n=a or g
attaaaccagtactgcaacataaatcaggggcattccagatctaaaaatgcaaatgaggaatcaataaagncaaaaattgctataagacatcaaaagatta

SEQ ID NO: 50602 - DNA, 101 bp, rice(Oryza sativa)
  misc_feature (71): n=t or c
taagtcagaatttaataaataattacttttagacctatattatcaagaagattccaaaagccagctaaagntgccatgtccatgttccacaagaaaatata

SEQ ID NO: 50603 - DNA, 101 bp, rice(Oryza sativa)
  misc_feature (71): n=t or c
gaagccatctttcgccacaattcttcaaagtgagcttcaagttcctgctgacaagctttcagcaactctcnataatttgtggtcatgatattgtcttgatc

SEQ ID NO: 50604 - DNA, 101 bp, rice(Oryza sativa)
  misc_feature (71): n=a or c
cgtcaagtttctctcctgtggtccaactcttttttttttcagttggacaaaagagaagaaccaaacaacanaacaaaatacaaacaaagatgcgattactt

SEQ ID NO: 50605 - DNA, 101 bp, rice(Oryza sativa)
  misc_feature (71): n=t or c
gatgttttttgatagggcacttatgtagcacctaaattgttgtgcttcgtagtgttccagtgggatacgcnatttaccctattctcagtcttgagttccaa

SEQ ID NO: 50606 - DNA, 101 bp, rice(Oryza sativa)
  misc_feature (71): n=t or g
agaagaggacaagatgacaacgtgggcaccccacctatgttgggccaggctacacttccacaagccgcacnctcatcttaactagggttgtcaaaatagac

SEQ ID NO: 50607 - DNA, 101 bp, rice(Oryza sativa)
  misc_feature (71): n=a or g
tttatatcatctgcaaaatctatagtccaacggatgaggccagtactaacaatctcgcacaccataacagntagacataagaacacttgttgatttcgcaa

SEQ ID NO: 50608 - DNA, 101 bp, rice(Oryza sativa)
  misc_feature (71): n=a or g
aaaataaaaatcccaaaaaaaataaaatcaaaaaatccgaacccaaaccctagaagccgttgtcgccgtcnccatcgccatcgccgaatctgccgccaccc

SEQ ID NO: 50609 - DNA, 101 bp, rice(Oryza sativa)
  misc_feature (71): n=t or g
agcgcggcatcttacgatcttcaagaaagctatgaaagcagctcgggagcaaacaataggaaatacagttnatccagggttcaccaagctgttctgggtag

SEQ ID NO: 50610 - DNA, 101 bp, rice(Oryza sativa)
  misc_feature (71): n=t or c
acgccgccgttgagaaggaggaggtcgtttggggagagggagaggagatcaccgtcgaggtggaggaggcngggagaagcgagagagaaggggcaagggaa

SEQ ID NO: 50611 - DNA, 101 bp, rice(Oryza sativa)
  misc_feature (71): n=a or c
accactggcatctcatcaccgaacaaatttcgtcagctccgggacggttttgcctcggcgttcagtcacancgccgtgacagccgcagcagcagcagcagc

SEQ ID NO: 50612 - DNA, 101 bp, rice(Oryza sativa)
  misc_feature (71): n=t or c
aactaaaaatatttggagcttgttggtattgaacctagcaaacatcataagagacaaaaagcaaacgtcanagattaatataatgaatttctataaaaata

SEQ ID NO: 50613 - DNA, 101 bp, rice(Oryza sativa)
  misc_feature (71): n=a or c
ggtcaggagtagaatctgcttaatttagctacaaaagtagcatcaagatcaggggatcacatagccacttnaaaaattcaaatgatggggactctctccag

SEQ ID NO: 50614 - DNA, 101 bp, rice(Oryza sativa)
  misc_feature (71): n=t or c
acgagagagaccttatctcctcatgcgagcgccgagcggaccttatatcctccacacgttgtggtggggcncaccggctcggctcaattcataggtgtcat

SEQ ID NO: 50615 - DNA, 101 bp, rice(Oryza sativa)
  misc_feature (71): n=t or g
aagattgacggtgttaggtgtttcactgtcaacgggtatatcgcctatcattgaaagaaattagccttganattgacaagattgacgaagttatcataggc

SEQ ID NO: 50616 - DNA, 101 bp, rice(Oryza sativa)
  misc_feature (71): n=a or g
tttctaatgaactagacgacgaacttcgttcggtgaaaagtcagtacaacatatgcaactagttatccgangatgcaagaagccatgaactatatatggac

SEQ ID NO: 50617 - DNA, 101 bp, rice(Oryza sativa)
  misc_feature (71): n=a or c
tggcccatggttcaccttaacaccaaagcaattttacggtgttatcttttcgcttacttatgcttattagncaaaatttaaatttttaactttaaatctgg

SEQ ID NO: 50618 - DNA, 101 bp, rice(Oryza sativa)
  misc_feature (71): n=t or g
acgatatgatcggtcgatctggtgttatgcgttagtggggaagagagtggaaggaagaaaacatgaagaangttaacatcatagcatcagaattctttgtg

SEQ ID NO: 50619 - DNA, 101 bp, rice(Oryza sativa)
  misc_feature (71): n=t or c
ggtttcaaacaccacctaatacttccaacacaagtttaacaaaccgtttgagatggggttaccaccaccgnatggtttgatggttaccagtaggggtgaaa

SEQ ID NO: 50620 - DNA, 101 bp, rice(Oryza sativa)
  misc_feature (71): n=t or c
tcccggcgatggctgccgccgctcagacctgtcacagggacagaacacaagcgctgcacatgttcagttcnatcgccgccgttggccaacccaatgcgtcg

SEQ ID NO: 50621 - DNA, 101 bp, rice(Oryza sativa)
  misc_feature (71): n=a or g
tgctcaggcagaatgcatggaacgttgcacgtacgtacgatcgacgtgcgcttattttaatttaactcacnaagacaactaacccatgagcaaaaacatgg

SEQ ID NO: 50622 - DNA, 101 bp, rice(Oryza sativa)
  misc_feature (71): n=a or g
atcaaggtgatcgaaggtgcctgaatagtttccaattcctgccatgcccaggaggccaggaacaaacctantaggagaataacagtaactttttttttctc

SEQ ID NO: 50623 - DNA, 101 bp, rice(Oryza sativa)
  misc_feature (71): n=t or g
gtcggtgcggaacgtgtacgccatgggcaaggtgcggatggtggcgtccgagttaaatttcggtcatttcngtgacccccgatacgatattaattcggccg

SEQ ID NO: 50624 - DNA, 101 bp, rice(Oryza sativa)
  misc_feature (71): n=a or g
tccggttcactctgggttgattgcatgagcggtccttaaagcaaaccgaaccggttagagtgctggttctngtttttttactatgttacaaactactctct

SEQ ID NO: 50625 - DNA, 101 bp, rice(Oryza sativa)
  misc_feature (71): n=a or g
gggaaggtcacacccaagtctgcgcaccagcgacctgcgcgacaagatcgaggtgggacgtcggctaaacnccgacctccgcaacgtcatgaacaagcgtc

SEQ ID NO: 50626 - DNA, 101 bp, rice(Oryza sativa)
  misc_feature (71): n=a or g
ggtcacgctgaatcaaagcaacgacctccacagtgcgagattccttccccacgctctcttttttcggcaanataacgcgtctcccaactagagggcgcgcg

SEQ ID NO: 50627 - DNA, 101 bp, rice(Oryza sativa)
  misc_feature (71): n=a or g
tccttcagaaatttttccaagagctctcatcttatcctaagaatctatgaaataaatttgcaagactacantcctcaggaaattggtagtgtccatttcta

SEQ ID NO: 50628 - DNA, 101 bp, rice(Oryza sativa)
  misc_feature (71): n=t or g
cgcccacgcaggccccgcatccttgctctggcgtccgcgccttcatcgctgccccatcgtggctaggtganggaccgttcgacagctcgcccccgtgcggc

SEQ ID NO: 50629 - DNA, 101 bp, rice(Oryza sativa)
  misc_feature (71): n=t or c
ggacaccaccatccttcacccatgtctacccggcatacaagccgatcctcgacggccggagcagcgcaggngacggcgacggcgacgtcgacgatgtgatg

SEQ ID NO: 50630 - DNA, 101 bp, rice(Oryza sativa)
  misc_feature (71): n=a or c
gttggactctcaaaccaatcacatacgcatcaatcttacataagcatccgtagtttatataaacgatgcanaaacatacatatatacatatatatatatat

SEQ ID NO: 50631 - DNA, 101 bp, rice(Oryza sativa)
  misc_feature (71): n=t or c
gggacaaccacgcaacagattatccttgtttttagagtaaattgtatatttgtattcatggtacatgaacntgtatagtgggtgcaaatagatacaacaac

SEQ ID NO: 50632 - DNA, 101 bp, rice(Oryza sativa)
  misc_feature (71): n=t or c
tatcctcgtcgtgcatgccacaagtatagcaaaatactacttccatttatctatctaccctataattcacnggccagggtttacgattccaagatggcctt

SEQ ID NO: 50633 - DNA, 101 bp, rice(Oryza sativa)
  misc_feature (71): n=a or g
tgaggccgacgatagttcatgacgtgaggcagtggtctaaggcgccaagggaagcgttggccgttggttcntagggattatttaaactggctgtcatagta

SEQ ID NO: 50634 - DNA, 101 bp, rice(Oryza sativa)
  misc_feature (71): n=t or c
acaaaacagcaagctcaacaaggcccactagtctaaccctagaatctctcggaggcaactccggctcggangtccgatgtttggggaaaaatcggacgctg

SEQ ID NO: 50635 - DNA, 101 bp, rice(Oryza sativa)
  misc_feature (71): n=t or g
aataccggaatcgcgacatcaaacgtcgacacaaataatctgcattattttcccatatgaaattatgaacnggcacaaattggtttgcaaaccgggaattt

SEQ ID NO: 50636 - DNA, 101 bp, rice(Oryza sativa)
  misc_feature (71): n=t or c
cttttatttctagaataagttcactttacgttctttatcttagacattgaatttgaattacctccttaaancgcaatactatacatatataacacatccct

SEQ ID NO: 50637 - DNA, 101 bp, rice(Oryza sativa)
  misc_feature (71): n=t or g
ttaggcagtagtctaatgtctatattcatcattttttgatgtgtacagcccaacctttacagtttttgctnctaatatacagaaaaatattaagatttgtc

SEQ ID NO: 50638 - DNA, 101 bp, rice(Oryza sativa)
  misc_feature (71): n=a or c
aagatgttagtacttgtaatggataagggtgtttccttgggtaatgtatcttgcaaattaggggtcaaaangagataactactatgaatcacatactatcc

SEQ ID NO: 50639 - DNA, 101 bp, rice(Oryza sativa)
  misc_feature (71): n=t or c
caggcgaagcgagcattggtagtcactaccatgcccatgctcgtttgctcgttgggtacaggttttgaccnaataagaaacccatggggtattaaatgggg

SEQ ID NO: 50640 - DNA, 101 bp, rice(Oryza sativa)
  misc_feature (71): n=a or g
agttaaaattgaggaaaaaaatttctatttacccaaaagagtgaaaatagcactttggtgaacacctccantttaagatagcattttagtgaattagtttg

SEQ ID NO: 50641 - DNA, 101 bp, rice(Oryza sativa)
  misc_feature (71): n=t or c
agaaacaaacaaggcaaagggcctgtttgggggagctttaggggctgtttggttcgcatcctgatgcttgnatgcctggccggagcgctgcctgagctcca

SEQ ID NO: 50642 - DNA, 101 bp, rice(Oryza sativa)
  misc_feature (71): n=t or c
cgatgacgacgatggagatcgacgccggcaaaacaacaatgggcgacgacgaggctcacaagaacccaaangtcatcctcggaaccctgcgccggaactga

SEQ ID NO: 50643 - DNA, 101 bp, rice(Oryza sativa)
  misc_feature (71): n=t or c
gttgggatggaggaaagaactgagttaatcaaagttaatcttcccccttggggcaaaaacatagaacttgntgtcagccttctttccactctatccaccaa

SEQ ID NO: 50644 - DNA, 101 bp, rice(Oryza sativa)
  misc_feature (71): n=a or c
aatcctcaacatgagaaatacgtgtatatatagaactatgtatagttttatagatcctcctacttctcagnatgaggaaatcaactccaacaatcaccgct

SEQ ID NO: 50645 - DNA, 101 bp, rice(Oryza sativa)
  misc_feature (71): n=a or g
gctaccagtacacagaatttcaactcttagtgaccctttgaatcaaaagaatttatataggaatttcatangattacaatcctatagaaaattttcctatt

SEQ ID NO: 50646 - DNA, 101 bp, rice(Oryza sativa)
  misc_feature (71): n=t or c
atatatatagaagggagctgtggttgctcacctgatttgcttaagggtgaacaatttgacatgctggtacngtgtgtttcaaatcattcagaaaagtcatg

SEQ ID NO: 50647 - DNA, 101 bp, rice(Oryza sativa)
  misc_feature (71): n=a or g
tgggacaaatttaaacgagcatgcctgttatttgttgggatgaggaaataggtagagaaattaaaaaaatnattgtgattagctgaaacgatgaaataggt

SEQ ID NO: 50648 - DNA, 101 bp, rice(Oryza sativa)
  misc_feature (71): n=t or c
gctagcaagcaagttcaacaacatgcaaattactctttttggtataatgacttgggtagtccgtatggacntgtccaaaacaatctgtggagattatgggt

SEQ ID NO: 50649 - DNA, 101 bp, rice(Oryza sativa)
  misc_feature (71): n=t or c
acatcatctctctctttcccctcttatctcccttcctctctttctctcactttgctccttgtctggtgatngatgacggacgatgcggcggcgacttggtg

SEQ ID NO: 50650 - DNA, 101 bp, rice(Oryza sativa)
  misc_feature (71): n=a or g
gcaggatcctgtattgtataattttgtgtgttaagaaagtatggaactcacggtaccaacctctggactcntgccactcgttgagttgatattggctctat

SEQ ID NO: 50651 - DNA, 101 bp, rice(Oryza sativa)
  misc_feature (71): n=t or c
gttcaagacctttctagtctcagattatttcctcggttccttcgcattttattcaagttagatggataccnagagagctgaacaagatggctgacaaatta

SEQ ID NO: 50652 - DNA, 101 bp, rice(Oryza sativa)
  misc_feature (71): n=t or g
cgtctgtaaattcgaatgtttagcctgcatgatgttgctcatgccatttgtaatgtgcacttgttttgctnttcatttctgtgaagaagacaggcctctgt

SEQ ID NO: 50653 - DNA, 101 bp, rice(Oryza sativa)
  misc_feature (71): n=t or c
tatgcattttagcttcttctgggctaactgtcacttccattttcgtttgtaacctagctctacgctttatntggatttatagttctatttgagatttgata

SEQ ID NO: 50654 - DNA, 101 bp, rice(Oryza sativa)
  misc_feature (71): n=a or g
atccacgccagacagggagaaacacaaaagtaatgccacgtggacaagaaaagtgaaaatagtgatatatngaaaatttcaattaggactggtggcaaatg

SEQ ID NO: 50655 - DNA, 101 bp, rice(Oryza sativa)
  misc_feature (71): n=t or c
ggattgaatcccaataattccgcagcgattacttctgtaacagcaagcggatcaattcctcgattgattgngtcgttactgcaggagtggaagcgattggg

SEQ ID NO: 50656 - DNA, 101 bp, rice(Oryza sativa)
  misc_feature (71): n=a or g
gcatggaaggttttgacaaaagttcgcacgtactagccaagttattgtactagtgtatgactagtaatttntccgtactaacgttacagtagtatttagta

SEQ ID NO: 50657 - DNA, 101 bp, rice(Oryza sativa)
  misc_feature (71): n=t or g
catcgggtagttgcgtcgtgtctgcgttctatacccatggttcctaacttccctcactcgttttccgcgcncacacttttcaaactactaaacggtgtgtt

SEQ ID NO: 50658 - DNA, 101 bp, rice(Oryza sativa)
  misc_feature (71): n=a or g
atcccaactaatgaaaccggtgcaaaaggagtttttttttgagagctctccactttgagaacaagctgtantaactgaacatacgtgcaaacgcactccac

SEQ ID NO: 50659 - DNA, 101 bp, rice(Oryza sativa)
  misc_feature (71): n=a or c
actccctctgtcccaaaaaaaaaatccatttatagcatcataatgtggaattagtagtgatggaaaatgantaaaatacccttaatcattgaaaaaaatag

SEQ ID NO: 50660 - DNA, 101 bp, rice(Oryza sativa)
  misc_feature (71): n=t or c
aagatcgactccacctcgcacctctccctaccccgcgcattctccttcccctatcgctccccagtccccanctcccctccccgaatcgtcgccgccacctc

SEQ ID NO: 50661 - DNA, 101 bp, rice(Oryza sativa)
  misc_feature (71): n=t or c
cagtggcaatcacagcaatagtgagcatcacagcctcaatccgattccatgtccactaatgaatgcagctnagtcagttcagccagctctgccagcctagc

SEQ ID NO: 50662 - DNA, 101 bp, rice(Oryza sativa)
  misc_feature (71): n=t or c
taaggtttgagaacaaaatgctatgggctacctttgctaaatgactactccatgcatgcgtctatataaancataatcaattcagctttttaatgatattt

SEQ ID NO: 50663 - DNA, 101 bp, rice(Oryza sativa)
  misc_feature (71): n=t or g
taaaacattttcatttccattatcgaaagaaaccactaatggccctacatcgaaccaactgaggagatcgntttcaaaaaaaaaaaaggaaatgacattat

SEQ ID NO: 50664 - DNA, 101 bp, rice(Oryza sativa)
  misc_feature (71): n=t or c
tttgtgatttgaaacctagggaagggtggggctggcgggaaattgtttttgggcaccatgagtatttttgnagacggggctactataacgcttgtatcatc

SEQ ID NO: 50665 - DNA, 101 bp, rice(Oryza sativa)
  misc_feature (71): n=t or c
gaagttgataaatatccatatggccgctgtctttatgctccgtcacatagtatttagtactccatccgttncagaatataagaagttttaaggttggacac

SEQ ID NO: 50666 - DNA, 101 bp, rice(Oryza sativa)
  misc_feature (71): n=t or g
atgtttcatgatgattttattaggcactatgtgcacacatggcctccatgcaaagctggctcgtgagctanacgaggtcgacgacgaggatgatgatgatg

SEQ ID NO: 50667 - DNA, 101 bp, rice(Oryza sativa)
  misc_feature (71): n=t or c
gaaattaagcaaatgatcgaggagagttaattagctcatgctcatatgcatgcacgcacgtatacgccccnctctacctaaccctagcttagctttgcccc

SEQ ID NO: 50668 - DNA, 101 bp, rice(Oryza sativa)
  misc_feature (71): n=t or g
tgagtcattgggaagttgttaaaatcatgcatgctgctgtcatgataggctgaaggaatcaatgaccgcancttgctcacagcagacgggagcatgtatcc

SEQ ID NO: 50669 - DNA, 101 bp, rice(Oryza sativa)
  misc_feature (71): n=a or g
aaattcagtcttttggggttcttttaggggtaacaatccataatcttcttatgttcttatcacatattcangaaatttaatatatgttattttctaaatct

SEQ ID NO: 50670 - DNA, 101 bp, rice(Oryza sativa)
  misc_feature (71): n=t or c
gatcaaaagtcaaaatccattttcaaagggttaaaatttgtgaaaatcctattatgtgtttcaaatgtttngtatcgaaagtaatgagaatgtcaagtacc

SEQ ID NO: 50671 - DNA, 101 bp, rice(Oryza sativa)
  misc_feature (71): n=a or g
ggggaggcgagtattggagctgtatggttcttgggatgcattccatgttcagctaatttttttaaataagncggatcgttaaacgtgagatacagaaactc

SEQ ID NO: 50672 - DNA, 101 bp, rice(Oryza sativa)
  misc_feature (71): n=t or c
tcacacatacatgtacgtaatatttatggatatcaggagttaaattctattggatgaaatcagatattcangacttaaccaccacactcctacttgtactt

SEQ ID NO: 50673 - DNA, 101 bp, rice(Oryza sativa)
  misc_feature (71): n=a or g
gtcttagcaatgatgaaaatatatccttcattttgttgcttcctacgaactgatattaactagcaacatcnacaaatcgcatgtacaaagtctgtagtcgt

SEQ ID NO: 50674 - DNA, 101 bp, rice(Oryza sativa)
  misc_feature (71): n=t or c
aattttggggtgggatctaaacagggcctcaagtctaggtataaccatataagctagtccttgtttagttncaaactttttcttcaaacttccaacttttt

SEQ ID NO: 50675 - DNA, 101 bp, rice(Oryza sativa)
  misc_feature (71): n=a or g
tgcgcgcgtcaaaatgtgttcccggacaaggactaacgttgagacgatgcggtgctaccggcgagacgttnctgtcgtcgttgccaccggccgtgcgcgcg

SEQ ID NO: 50676 - DNA, 101 bp, rice(Oryza sativa)
  misc_feature (71): n=a or c
gggaggagcgaccgtgtcatggcatggcatcacgtctgatgaaacgaggtacgtgagcatatactcgctcnaaaaatgtatgatgccgtttatttttcgct

SEQ ID NO: 50677 - DNA, 101 bp, rice(Oryza sativa)
  misc_feature (71): n=a or g
tgaaaattatgagctgagccttcggaagttgtcttggtagggtaatccacattcgtggtgttctctaggtntccaagttgggaatctttgtggtcatttga

SEQ ID NO: 50678 - DNA, 101 bp, rice(Oryza sativa)
  misc_feature (71): n=t or c
ccagcctctttttttttatcatcattggttgccataggatggaatcctcttttatttttttagtgaagtgnacgggcggtccttaaacttgtagggatgtg

SEQ ID NO: 50679 - DNA, 101 bp, rice(Oryza sativa)
  misc_feature (71): n=t or c
ttttgatcatcaatgttattgttgtttacctactgatctagtagctcacaaattagtaccattattatatngtggtactttttactaagcttcggctgtgt

SEQ ID NO: 50680 - DNA, 101 bp, rice(Oryza sativa)
  misc_feature (71): n=a or g
tgactaaacttgagtagacaagtttcaccacacaagaaaccttaaccaagttggcctatgctcactatatntatatatatatatgtatgtatgtatgtatg

SEQ ID NO: 50681 - DNA, 101 bp, rice(Oryza sativa)
  misc_feature (71): n=t or c
tctctcacgcctctcctctcctctctccactcttggcgatagcagcggcgtagtggtggtgggaggagcgngccggcctcctccatgtggcggcggtggag

SEQ ID NO: 50682 - DNA, 101 bp, rice(Oryza sativa)
  misc_feature (71): n=a or c
ccatggatggctagctagctagatcgatctatcgatgcagagtgattagctagctagctagaattggtganttgtggtgacgacgagatcgttagcaacag

SEQ ID NO: 50683 - DNA, 101 bp, rice(Oryza sativa)
  misc_feature (71): n=a or g
tggcacaatggctagagggctctaagctattttgctttgttcagcggtggcggttctgggagacaaatagncatatggatagtgaagaagactaagggtca

SEQ ID NO: 50684 - DNA, 101 bp, rice(Oryza sativa)
  misc_feature (71): n=t or c
agagatgatgaaaaaaataccaactcgtgcaacactgaagacaacgataaatgataacaaaattatactanccctatcctaaaatataataactttagcta

SEQ ID NO: 50685 - DNA, 101 bp, rice(Oryza sativa)
  misc_feature (71): n=t or c
tgtaccagataacttctatatttaattgttttggtttttgatcatttcaatataaaaaatggcttaagctngagagtaagaaaagcgatcacattatctta

SEQ ID NO: 50686 - DNA, 101 bp, rice(Oryza sativa)
  misc_feature (71): n=a or c
cgccggcgtaaaatttgagcacgtcgacttcgcctactgcgacgtcatcatcccgtggagcttcgtcaacngcgtcaaggccgagttcgggagcaggcacg

SEQ ID NO: 50687 - DNA, 101 bp, rice(Oryza sativa)
  misc_feature (71): n=t or c
tagcaaaaaatgacaatgacaacaaggtgattctgcattaatatacttccagttcttggctttttagaagntttccattgctaatatgttcgaacattctt

SEQ ID NO: 50688 - DNA, 101 bp, rice(Oryza sativa)
  misc_feature (71): n=t or c
tttgaaaagacaagggccaacatctcaacatactctaataaatcatggagtatatatatttctactttagntggaatacatagcaaacaaattaaaagata

SEQ ID NO: 50689 - DNA, 101 bp, rice(Oryza sativa)
  misc_feature (71): n=t or c
tgaggcaaaatagacttattacaaggaggagcacggtgggcttatcgtgccttcggccagcctggcacaantcaactaatctcgggacgtgtctggtcatt

SEQ ID NO: 50690 - DNA, 101 bp, rice(Oryza sativa)
  misc_feature (71): n=t or c
atgaacgcaacaacatcacaatcaggtaattgatatattgtttaaatctgattagtaactttcatgcctcnattagttagttgaggaaaaaattgcaaatt

SEQ ID NO: 50691 - DNA, 101 bp, rice(Oryza sativa)
  misc_feature (71): n=t or g
aggaggtcagggaagggcagtggcgacggcgtcgcacagagctagggtgtctctttttggaactttttttngccgaaaattatcttgcagtcgaacggcat

SEQ ID NO: 50692 - DNA, 101 bp, rice(Oryza sativa)
  misc_feature (71): n=a or c
gagagctggataaagattgcatataatggagatccaacaagcatttgcatagaagcgaggacttctccgtntaatttatgctcaataaacttatctgtggt

SEQ ID NO: 50693 - DNA, 101 bp, rice(Oryza sativa)
  misc_feature (71): n=a or g
gtggacggcgatggtaaatcgtagacgttaagggaaaggcgatggcatataatagaagtcgacaaagtcantggcatattgttgaaccgtgatgaactcag

SEQ ID NO: 50694 - DNA, 101 bp, rice(Oryza sativa)
  misc_feature (71): n=a or g
ggccatccgagtatattaagaagaagtaaagttacaaagaaaaacacgatagaagctgtcgaggacggacntgcatgaggcacctccaagaaccacacgct

SEQ ID NO: 50695 - DNA, 101 bp, rice(Oryza sativa)
  misc_feature (71): n=a or g
aatatcaacgcattatacctagaatccttttggtgatatgaataggcacctttggtatgcatgaaataggncctaacttacctgtgatgggttatttgtaa

SEQ ID NO: 50696 - DNA, 101 bp, rice(Oryza sativa)
  misc_feature (71): n=a or g
tgatgcgtggtggattaggaacgcgaataaaattaaaaccaatccgtgtgaccggaaaccacatcggtgtnttcccaaaacaacgtattaactccaaaaaa

SEQ ID NO: 50697 - DNA, 101 bp, rice(Oryza sativa)
  misc_feature (71): n=a or g
tactactacattgcagtagttggttgctgatcgagctggatattgcagccaagaaacgcatgttctaactnaatgcatcttccattctctgaagacgctta

SEQ ID NO: 50698 - DNA, 101 bp, rice(Oryza sativa)
  misc_feature (71): n=t or c
acagaaactttccttttccttgttgattttgggtggagtggggctggttgctcacctgcaaaataagatgnaagtcttattggtacccatttaaatttaaa

SEQ ID NO: 50699 - DNA, 101 bp, rice(Oryza sativa)
  misc_feature (71): n=t or c
tatctagcacgtccatagttttctataactttcaccacgtcttcaaatttctaacaattttccactgtttnccctatttccataaaggaaaaaataatttt

SEQ ID NO: 50700 - DNA, 101 bp, rice(Oryza sativa)
  misc_feature (71): n=a or g
ctactaaaaacgccgacgacgaggaagaccttcaaatcacgaactagtcgctccgacgacgacgacgacgncgacggcgccacgacaaaatctccggcgac

SEQ ID NO: 50701 - DNA, 101 bp, rice(Oryza sativa)
  misc_feature (71): n=a or t
cagcaagaagtagccaatttacatgaatgtaagagtgcaagactatccttctctattacaagacccccggncactgatctagaacctgtctgattgaatgc

SEQ ID NO: 50702 - DNA, 101 bp, rice(Oryza sativa)
  misc_feature (71): n=a or c
cgaagctccatctgaccaaaaaccctagccaccatgaaaaaaccccaccaacgaaaccctaattcccgccnaccccaagaaccgcaagaaacccccccccc

SEQ ID NO: 50703 - DNA, 101 bp, rice(Oryza sativa)
  misc_feature (71): n=t or g
ttactctggagtctggatgaacaactctgcctggttagttccttgttgaagtgttgatcgagccaacatcnctgatctgcttatgttgattggttgtcact

SEQ ID NO: 50704 - DNA, 101 bp, rice(Oryza sativa)
  misc_feature (71): n=t or c
atttagaaaattttggttaaaagtcgcatccaacagaatccctagcatgtcttccaataatccagattccnaactctggatatgtcattcccgctcaaggg

SEQ ID NO: 50705 - DNA, 101 bp, rice(Oryza sativa)
  misc_feature (71): n=t or c
tagctaaaatttttccgatttaccaatagctaccaaacttaattaagaaaccctcacatttttcctagaanttttgcatgcctggagaatgggttaaaaat

SEQ ID NO: 50706 - DNA, 101 bp, rice(Oryza sativa)
  misc_feature (71): n=t or c
atatataagcacaagaaataattaagatcagattttatatatgtaggcagaaaaccagcataaggaaaatngattgaaatgatctaagtacattacgtact

SEQ ID NO: 50707 - DNA, 101 bp, rice(Oryza sativa)
  misc_feature (71): n=t or c
aaaaaagcacacatccggatcctccccatcacgaaggtcccaacaagctatcttcatgacaaattaaaatnaaaattatttttacattaagaaaaccacaa

SEQ ID NO: 50708 - DNA, 101 bp, rice(Oryza sativa)
  misc_feature (71): n=t or c
tgaaattgctaaaaaaaaatccgtctactatacaagttaatcgaaacgcagaagcctgtaaccgatgctanacacctgcgaagtttcagacataaagggat

SEQ ID NO: 50709 - DNA, 101 bp, rice(Oryza sativa)
  misc_feature (71): n=t or c
ttcaaacctctgagtgaagaaataatttagtgtgacaatatttggtttctatatattgtaaaatgtgaganaaaaaacatgttaacatgtgtatttgtaca

SEQ ID NO: 50710 - DNA, 101 bp, rice(Oryza sativa)
  misc_feature (71): n=t or g
gggcccagagagcagtacttagccgtttagctgaattagttggctttggtcagagctttgggattactggnccaaagatttcgtggcttgttgctagtatg

SEQ ID NO: 50711 - DNA, 101 bp, rice(Oryza sativa)
  misc_feature (71): n=t or c
cattttttttgtatatttttttgcaagatagaaatatattatcgatcatgatcgttccatgaattattccnggcaaaattctggaccttagcgggatatcg

SEQ ID NO: 50712 - DNA, 101 bp, rice(Oryza sativa)
  misc_feature (71): n=a or g
attaagctgcaaaaaaaactaaattagcaaatggcaacggcagtctgcaggtctcaacagaaagaaacctntgtttcagcaaaatgtgacatttgtgtgtg

SEQ ID NO: 50713 - DNA, 101 bp, rice(Oryza sativa)
  misc_feature (71): n=t or c
gtcttgtttggaaaagcctctctctttgaaaggcttcaatgttaggaaaaatttaacctcctttggatagnagaatcacatgctccgtcttctaatactag

SEQ ID NO: 50714 - DNA, 101 bp, rice(Oryza sativa)
  misc_feature (71): n=a or g
catgcttctagaccaataataatataaaggcggactggaaaatcgagttcgatctcacttctcagggtgtntttagttcacgctaaaattagaagtttgat

SEQ ID NO: 50715 - DNA, 101 bp, rice(Oryza sativa)
  misc_feature (71): n=a or g
cacctagtacacctttgactgggagactttccttgatgatcgacgtggtcatattcttcagattgatttantttcagatagaaaaaaatattgtttactta

SEQ ID NO: 50716 - DNA, 101 bp, rice(Oryza sativa)
  misc_feature (71): n=t or c
tggatcgatcaccaaaacttcaccctgatctgatctggaataacagggattaggtgtgcagcatgcataantacaggaatggtaaaaaccttcaggcccct

SEQ ID NO: 50717 - DNA, 101 bp, rice(Oryza sativa)
  misc_feature (71): n=t or c
gagttgtggaagtgtagggagtagcatgggcgaggggattgaatttggtcatactatatgggggtagtganatttttttttccttttttgagggaaaaagg

SEQ ID NO: 50718 - DNA, 101 bp, rice(Oryza sativa)
  misc_feature (71): n=a or g
tgaagctattgtgcagatactgtatactgtttttttttaaacaaagttggatactggagttcctgtgactnattgaaaatcatagctctcttggattgagc

SEQ ID NO: 50719 - DNA, 101 bp, rice(Oryza sativa)
  misc_feature (71): n=a or g
atgaagagagtgatgggaagctcggaaaggattgccgcaaatgtcggagttttcttcgggagttatgaggnagtgccgaagatgtcggcattcttccaggg

SEQ ID NO: 50720 - DNA, 101 bp, rice(Oryza sativa)
  misc_feature (71): n=t or c
acacacattgtgttatattatatggttacaactactatggcttgataaagggtctaaacactgtttcccanttcagttgaataaattgctattctcgaata

SEQ ID NO: 50721 - DNA, 101 bp, rice(Oryza sativa)
  misc_feature (71): n=t or g
aatctgcaaatgtcactaagccaagtatgattgagctaagagccctgtttgattcagttacttgtcttaangacaccgtaaagatttttatatatatagat

SEQ ID NO: 50722 - DNA, 101 bp, rice(Oryza sativa)
  misc_feature (71): n=t or c
gggttgaatggatgaatttactgcaattattttttttttggcccaacaaataggtgccggtttttaggctngaaccggcacctatgtggtcctaataggtg

SEQ ID NO: 50723 - DNA, 101 bp, rice(Oryza sativa)
  misc_feature (71): n=t or c
aaattcacaaaaaaataatttttttggccaaaataataggggggggggggttctgaaatgaccgaaatttnagaaatttcattccgaaatttgaaccctga

SEQ ID NO: 50724 - DNA, 101 bp, rice(Oryza sativa)
  misc_feature (71): n=a or g
aagtttgttagagtcaactctccgttcctgtcccaatttaccgtgtcctaaaataaagggggaaaaacacnttttttcccaaaaaaacgaaaggaaaacag

SEQ ID NO: 50725 - DNA, 101 bp, rice(Oryza sativa)
  misc_feature (71): n=t or g
ttttaataactctgtaaggcctttggtccttctttattctttctaagatatccaacaaatctcatgttgcncataatttagaaaaaagtaacttgtttttt

SEQ ID NO: 50726 - DNA, 101 bp, rice(Oryza sativa)
  misc_feature (71): n=t or c
agagaagagatatactccaatcacaaattcctaatcaaatgaatgtactacatgtttcttgtggttggttnatgcctgatggttaatgtcctgcaatagta

SEQ ID NO: 50727 - DNA, 101 bp, rice(Oryza sativa)
  misc_feature (71): n=t or c
ttaaattgtgaagcgttgccctgccataatgtgatgtgtttccactttccaatgccaataaaaagtagccngtctaatggtatttaacatccataaaacat

SEQ ID NO: 50728 - DNA, 101 bp, rice(Oryza sativa)
  misc_feature (71): n=t or c
tttccgtacggtcttcgtaaggagctgcacaagataatgggaattatcccatgcagtcggattatatgccngcacgggataatgtattttcccgtgcgggc

SEQ ID NO: 50729 - DNA, 101 bp, rice(Oryza sativa)
  misc_feature (71): n=a or g
cgagcctgaacatgatcactcgcatggtgatgggcaagaggtacgtgcagggcgaggtggtccatgagganccgggatcggcgcggacgacgctggcgcag

SEQ ID NO: 50730 - DNA, 101 bp, rice(Oryza sativa)
  misc_feature (71): n=a or g
cgaaaccatcgatcgttagcgtattttcggcaataattaattggctagctcattgcaacgtggaaactgtnaagtaccaatgcagtaactgttgcactgaa

SEQ ID NO: 50731 - DNA, 101 bp, rice(Oryza sativa)
  misc_feature (71): n=t or c
gagttactcgagaaagacttattcatagtggagatagtcaacctccacgggggctccccggccggggaggnaaaggggattgctatcgtcaccctttctcc

SEQ ID NO: 50732 - DNA, 101 bp, rice(Oryza sativa)
  misc_feature (71): n=t or c
ttttattgtatccacacatatcctttaaatatttgtttttagcttagggctgcgtacgtttcaaggtggtntgtgttttggatgatcaggcgtacagaaaa

SEQ ID NO: 50733 - DNA, 101 bp, rice(Oryza sativa)
  misc_feature (71): n=a or g
gaaggaattagcttgtagcctgttgcgttgcattgttcttagatacgttctgttcgtacgtaaggtttacntgttcttcgataagttgaaaggtggagaat

SEQ ID NO: 50734 - DNA, 101 bp, rice(Oryza sativa)
  misc_feature (71): n=t or c
caccgcctttacaacattaagcaagtttcaaaggctataatctctctaaagctggtgctgcggcaacactnaatgagctaactagccctgctaattttcaa

SEQ ID NO: 50735 - DNA, 101 bp, rice(Oryza sativa)
  misc_feature (71): n=t or c
agcgaatcaatggtagttgagagggaagatgctagtattttgtttgcaagtagacatgaaattttcaatgngatggggatcgataatcaagagaggaactc

SEQ ID NO: 50736 - DNA, 101 bp, rice(Oryza sativa)
  misc_feature (71): n=t or c
tatacgtccgactcccatcctacccaacctcacctgcaaaagtttcgctccacgcagaccagcttctctcnatgtgggccagggcaattagcagctaagag

SEQ ID NO: 50737 - DNA, 101 bp, rice(Oryza sativa)
  misc_feature (71): n=a or g
cccagccgctagtcacactagtcgtatcactagtcgtatttgcttgagccgatgtgtgcacacatcgatcnctagttgtatttgcttgagccgatgtgcgc

SEQ ID NO: 50738 - DNA, 101 bp, rice(Oryza sativa)
  misc_feature (71): n=t or c
aggaatctagcgaagcggaggtgtatcataagtggatcttgttggctcgcgtttggttggctagttttagntggacggcgacggatgaaggtgggctaaac

SEQ ID NO: 50739 - DNA, 101 bp, rice(Oryza sativa)
  misc_feature (71): n=t or c
agccttgagaggagtggatcagacggtggcggtgctaggggaggcgaatccgatagtggtgggcaggagangtgacagcggtggtggggaggcgcggcggt

SEQ ID NO: 50740 - DNA, 101 bp, rice(Oryza sativa)
  misc_feature (71): n=t or g
gaaagaagcagctgtccgtcaatttcattgaaggaatccaattacgtttaccaaatttaaattttggcaanattttttatatatttatcaaatttggcaac

SEQ ID NO: 50741 - DNA, 101 bp, rice(Oryza sativa)
  misc_feature (71): n=t or c
ttaatattgttgaataaattaatgatgtaatttttattaaaaatgatagttatagtgaagtttgctcgggntaaaaaatatttctacttgcgccactgcga

SEQ ID NO: 50742 - DNA, 101 bp, rice(Oryza sativa)
  misc_feature (71): n=a or g
tatgcagctgaaaaacgtctataagacttggaaaacttgcaaaaaccatatgagaagtcacttgaagtttnatatttcaccccataagttattttgttaca

SEQ ID NO: 50743 - DNA, 101 bp, rice(Oryza sativa)
  misc_feature (71): n=a or g
taaatggctttacaaaaggatcgatcgccttaggcgagctttcctttggaaaggtgacgatcctgaaaacnttagcgggggcagttgtcttttgaattgga

SEQ ID NO: 50744 - DNA, 101 bp, rice(Oryza sativa)
  misc_feature (71): n=t or c
tactccctccgtaaaaaaaaatccaacctatactatttagatgggacataatctagtacctgtccagattnattatactactttcaacttttctatcacat

SEQ ID NO: 50745 - DNA, 101 bp, rice(Oryza sativa)
  misc_feature (71): n=a or c
ttcacctagcatattcaaatctgaacaaattttagctgattctaaacatttgcaaaatttaaaagctgtgncaagttacaggaataaaaatattttaaaaa

SEQ ID NO: 50746 - DNA, 101 bp, rice(Oryza sativa)
  misc_feature (71): n=a or g
tcaatatcattttccaataagaagttatgccattattactgaagactgcgcaggagctaaagggctgtgcncgaacccgagaaaactctttgcattctcat

SEQ ID NO: 50747 - DNA, 101 bp, rice(Oryza sativa)
  misc_feature (71): n=a or g
tttttctatgaactctggtggatggaacccaatcgggtttcaggatgttgtggattccgccttcgtgatgncatgaaggagagatacatcccacttcaatg

SEQ ID NO: 50748 - DNA, 101 bp, rice(Oryza sativa)
  misc_feature (71): n=t or c
ttgttttcatcataataaatctagctagttactcacttcttagataattatatacgtctgcatatgtacangagtaggctggtatatacaacaagagacca

SEQ ID NO: 50749 - DNA, 101 bp, rice(Oryza sativa)
  misc_feature (71): n=t or g
aaaaacagaaaacgcgggcgctccaagcgagtgctgtccgccgcactagtagtagagaggagagactagangggttagaactgatcgcgcggggcgcaggg

SEQ ID NO: 50750 - DNA, 101 bp, rice(Oryza sativa)
  misc_feature (71): n=a or t
aatataataacttttagctatgaatatcattgtgacgtcaatgtccttacaaaattatggagcacctctcntttttggcgttgcatcggaagctgaaggca

SEQ ID NO: 50751 - DNA, 101 bp, rice(Oryza sativa)
  misc_feature (71): n=t or c
atatgaacccatgttgagttgtcccaatatcataaataaggcctagtttagatcccctggcaaattttttnaccatgtcacatcaaatgtttggacacata

SEQ ID NO: 50752 - DNA, 101 bp, rice(Oryza sativa)
  misc_feature (71): n=a or t
gagaatttatcaaccacaaccaatattgtgtcatacccttcagatttgggcaaaccttcgatgaagtccanacttgtcacgcccagaaatttaacccaaat

SEQ ID NO: 50753 - DNA, 101 bp, rice(Oryza sativa)
  misc_feature (71): n=a or c
ctatcagatcatctgtcgcccgatgacttccaatctctggcctgttgcaaaaggaaaaaaaagcatcgatngaagacctcgcatgcagttcatctgacgac

SEQ ID NO: 50754 - DNA, 101 bp, rice(Oryza sativa)
  misc_feature (71): n=a or g
tctaaccattcatgtttgtagagtatgttatttttcaaattatataacgcttgtgaacttgcatatgtgtntgattgtggaaatttaattttattatgcat

SEQ ID NO: 50755 - DNA, 101 bp, rice(Oryza sativa)
  misc_feature (71): n=t or c
cacgatggttcggcccagatgcggtcaaagcggaggggaacaaccatgcatggaaagaaaacgaagccgcngctagtcggccatggccgctagccactcgc

SEQ ID NO: 50756 - DNA, 101 bp, rice(Oryza sativa)
  misc_feature (71): n=a or g
cttctgtcttgatatattattctgtagattgtggtgggtgtcgattatctcgtgtctactctcctcttagngggccttgtatttatacccataggtgtccc

SEQ ID NO: 50757 - DNA, 101 bp, rice(Oryza sativa)
  misc_feature (71): n=t or c
cccacgaagtcgccaaacatttaatagggaatgatgggggatgtctcccgtgtcagccgtaaagtttcggnatgggccacccaaggttagccgcatggatc

SEQ ID NO: 50758 - DNA, 101 bp, rice(Oryza sativa)
  misc_feature (71): n=t or c
ctggttgtcaacagatgaactggatggatgatgcggcggcgtaggagcttggaggtggtggtgcaatggantacgaggttggcgtggcacatgttgaccat

SEQ ID NO: 50759 - DNA, 101 bp, rice(Oryza sativa)
  misc_feature (71): n=t or c
agtatggtggataggtgatactggtgggtgtggaatttggatgacggctgggatttaactagtaaggtgtnagctagggtttggttgtgtactagtcgatg

SEQ ID NO: 50760 - DNA, 101 bp, rice(Oryza sativa)
  misc_feature (71): n=a or t
ttgccggagtcgctggcttgttgggggtgtggaagaagaggagggaggaagatgaatgcttcccaccgttngatggtatagtttacatgtatggttgagtc

SEQ ID NO: 50761 - DNA, 101 bp, rice(Oryza sativa)
  misc_feature (71): n=t or c
tcttttcttattccaatcctctttccaagtgtataaatgaatagccccctcctctttttatatagtgcaancctaaatatgaaaggtttgatgatagaccc

SEQ ID NO: 50762 - DNA, 101 bp, rice(Oryza sativa)
  misc_feature (71): n=t or c
ggagctggtgtgcttagtagggccaagcaagctggtgtgcttagtagggccaagcaaggcagcccccgatntgaataggggtgtgcgtacccactcattag

SEQ ID NO: 50763 - DNA, 101 bp, rice(Oryza sativa)
  misc_feature (71): n=a or t
gcctgagacaggatttcgatatttgactgcgccggtatctggaagaaacgccatgtctccattattctcantgctaccaaggccatagaaaacaattgtag

SEQ ID NO: 50764 - DNA, 101 bp, rice(Oryza sativa)
  misc_feature (71): n=a or t
aaaaacttcccgtccaaatgtgtgatactttgagcatggaagacctgcatcgcaagattgggagggtaaanaaataaatatagcacttgggaatggaaaat

SEQ ID NO: 50765 - DNA, 101 bp, rice(Oryza sativa)
  misc_feature (71): n=a or t
gtatgatataaatgagattgttaatgagcagctcataagttaagccaagctaaccttttgctagcttgttnatgagttgagtcgacctagtttgtccccca

SEQ ID NO: 50766 - DNA, 101 bp, rice(Oryza sativa)
  misc_feature (71): n=c or g
agcagagttagttagcggcctataaatatggacgctactacatcgcctctacagtggacaaacaacctgangacacagagaggttgcgagctctaggaaga

SEQ ID NO: 50767 - DNA, 101 bp, rice(Oryza sativa)
  misc_feature (71): n=c or g
tgctcggcggtggaggcacaacagcaggggcagaagggtgcagggtgtgggtgttagaggtagacgatggngtgaaggtcagcgccgctgcaaggcggtgt

SEQ ID NO: 50768 - DNA, 101 bp, rice(Oryza sativa)
  misc_feature (71): n=a or t
tcaacgccaactgcctcatggagatggccatcccggaatcctacctcgaatccctccccaaggtgagaacnggcagctcacacgatccatccatccatcca

SEQ ID NO: 50769 - DNA, 101 bp, rice(Oryza sativa)
  misc_feature (71): n=c or g
ttggctgatctctgcgaaaaatgcacacgagatcacgttgagacacgaaatcggatcgagaactctctatncgcaccgagcccccgaacacatcaaacttt

SEQ ID NO: 50770 - DNA, 101 bp, rice(Oryza sativa)
  misc_feature (71): n=a or t
acgattgaagtacaacgttttagactctgcaccaaataaaaacacacacatttatatttataaacagaaantttttccgtttgaaccatcctttacctaac

SEQ ID NO: 50771 - DNA, 101 bp, rice(Oryza sativa)
  misc_feature (71): n=c or g
gtatatagtgtcacattttaagacccaccgatccagcccacacgttgaatatcaacatatctaatattcanaaaaacaaaaggagggtaaaaaagtacatc

SEQ ID NO: 50772 - DNA, 101 bp, rice(Oryza sativa)
  misc_feature (71): n=a or t
tgaagactaagctggtggcaaacgtcaagcctatatatttgcgactgatttgtattgattgtgcagggttnttttgtaaaacattttctagtttaattatt

SEQ ID NO: 50773 - DNA, 101 bp, rice(Oryza sativa)
  misc_feature (71): n=c or g
ggaattttgtgtgagaaaaaggaatatatgcacttctctcttggtcttcttttgtttttcacgtttatcantctcggcctctgtatcatgtgatgcaagta

SEQ ID NO: 50774 - DNA, 101 bp, rice(Oryza sativa)
  misc_feature (71): n=a or t
gtaccctataggacagaggagtatccaaacgaccaaaccctcaaatgccgtttccatctgattgttgttgntctattgtgattgtgttattccatatttaa

SEQ ID NO: 50775 - DNA, 101 bp, rice(Oryza sativa)
  misc_feature (71): n=a or t
cgccgccaccatcgatcatcagacacaacaacaacacagtcatatagagggaaacgagatttctcgtcgtnggaggaggggggccggacctgtgtcgccga

SEQ ID NO: 50776 - DNA, 101 bp, rice(Oryza sativa)
  misc_feature (71): n=c or g
gttaattctatcgataatataagtacatggacaactcatatctcctctctctaagcagcactccaaatctngcatggcatctctccaaggttgatgtcatg

SEQ ID NO: 50777 - DNA, 101 bp, rice(Oryza sativa)
  misc_feature (71): n=a or t
gggtcaaggtacgcattggtgatggcctaatctcgttgttggattcaagcacatcgcaaccgatgtcgccncctctcgctggttctcgcgctcctcgttgc

SEQ ID NO: 50778 - DNA, 101 bp, rice(Oryza sativa)
  misc_feature (71): n=a or t
aacgctcgaccatgccagatcttcttcctcgaccgtatctccttgtgggtgcacccgttcaaacactagangcacccgttcaaacactagaagaacaccag

SEQ ID NO: 50779 - DNA, 101 bp, rice(Oryza sativa)
  misc_feature (71): n=a or t
cccgctgtcgaggcgaaggcaatcgaagccagcccgtagtgatgcgatgaacacacacacacacacacagncagtcagtcaatccaacgatccgtatgtat

SEQ ID NO: 50780 - DNA, 101 bp, rice(Oryza sativa)
  misc_feature (71): n=a or t
ctcatcggcccattttgttgctaccctgggcgtctattattgtacaatgttgaccgtagtgtgggggattnggtgatataagcgttgtttcttttgtgatt

SEQ ID NO: 50781 - DNA, 101 bp, rice(Oryza sativa)
  misc_feature (71): n=a or t
ctctattgcaaatatctaaaattaagtcgatcacctgtaagtagccgacctcgacggtcttctcctacaantccctgatgtccatcacgccaagcgccacg

SEQ ID NO: 50782 - DNA, 101 bp, rice(Oryza sativa)
  misc_feature (71): n=a or t
acttaacgattgttagtactacttacttaccatttttacaatgttgaagtccaattttaaaaattttagtnctaataaatttattgatactttactttaaa

SEQ ID NO: 50783 - DNA, 101 bp, rice(Oryza sativa)
  misc_feature (71): n=a or t
ctttaaagatgaatccagctctttttggatacaatgtatgtatttgtaatacatgtgcgagtttttttttnaaaaaaactactaacacataaaatatcatc

SEQ ID NO: 50784 - DNA, 101 bp, rice(Oryza sativa)
  misc_feature (71): n=c or g
aaatgaaggaatttggatggctcaagccgcacaagcgaatgggcagcaattgggaaatcaatgtactaggncggaccgccattgctcgcaaggaaggttgt

SEQ ID NO: 50785 - DNA, 101 bp, rice(Oryza sativa)
  misc_feature (71): n=a or t
gctctctccccattagttgagagatgatgatgagagttgagagacaataaatagaccttttcttaaaaaanttttgtagcggcacaaaaatgcgaggctca

SEQ ID NO: 50786 - DNA, 101 bp, rice(Oryza sativa)
  misc_feature (71): n=a or t
aggaagaatcatagctaactttgaccagattgaaaggaatagcataatccaaaattaagcttgattttttnaaaaaaaatcttcatgatagaaagagaaga

SEQ ID NO: 50787 - DNA, 101 bp, rice(Oryza sativa)
  misc_feature (71): n=a or t
tttttttctagtgggggcccacctcctcatcgcctccctccctcacgcatcaatccctaaccacgctcccnacctcccccccccccccctgctataaaatc

SEQ ID NO: 50788 - DNA, 101 bp, rice(Oryza sativa)
  misc_feature (71): n=a or t
tgtgcgttgtttttgtttgctaaatttttgtttaaaaggaaacacgctggtcgtttgttctcagttttgcngatttgtgtactctagctacagataaatct

SEQ ID NO: 50789 - DNA, 101 bp, rice(Oryza sativa)
  misc_feature (71): n=c or g
gtctcatcttgctttgttctacacaatttcaggctctttacttcagttagcgtttttccgccggatagatnatcactcaagtatgtctatcctccctttta

SEQ ID NO: 50790 - DNA, 101 bp, rice(Oryza sativa)
  misc_feature (71): n=c or g
ccgcgatcgcggtgagagtttccgcccttccacctctttcaagtgaaggggagatgagctagatgcaaccnctgctttggcatgggaagggctcagagtgt

SEQ ID NO: 50791 - DNA, 101 bp, rice(Oryza sativa)
  misc_feature (71): n=a or t
ggttgatgtatcctgttaacacaacaaggctttaggtgatcttatcgtgttgatggcatcaacacaagcangcatggtgacttatataatatatcttaaat

SEQ ID NO: 50792 - DNA, 101 bp, rice(Oryza sativa)
  misc_feature (71): n=a or t
gtaagggtgaaagtagagaagcaaagagtcaagggacaagaaatacacttttcccacataaagagggtaanaaaaattcaagatctttcttaccgtaattt

SEQ ID NO: 50793 - DNA, 101 bp, rice(Oryza sativa)
  misc_feature (71): n=a or t
caaagcaattaagatagacaaacatggatcaaatttggatgtgttcaacagacatgccatctttgttaatnagcttgtctataaagaacttcacaaaggac

SEQ ID NO: 50794 - DNA, 101 bp, rice(Oryza sativa)
  misc_feature (71): n=c or g
cagccacttcaaacatatcgaaccgagcgacagaaaaaagggagaaaaattacggcggcgctagggtaggncgccgccgccgcccacattgatcctggagg

SEQ ID NO: 50795 - DNA, 101 bp, rice(Oryza sativa)
  misc_feature (71): n=c or g
gccgaccagataaagatggtttctccagtagtgcatggttctcatgcagacaaagaattgttgtattcttnatgttcattatattatatgaattaagtgtt

SEQ ID NO: 50796 - DNA, 101 bp, rice(Oryza sativa)
  misc_feature (71): n=c or g
caagcttcctgtcgtcgacggcgtgacgataaaaaatgtctggggtcagaacatccggcaagccgggctgntaaggggtatcagggactcggttttcagtc

SEQ ID NO: 50797 - DNA, 101 bp, rice(Oryza sativa)
  misc_feature (71): n=c or g
ttcagaagaagattgcaaataggactgaaaattgcttgaaacagagggtagagacttgtttatgtcaaaanttgaaactgatgatgaagctctcaagctct

SEQ ID NO: 50798 - DNA, 101 bp, rice(Oryza sativa)
  misc_feature (71): n=a or t
agttcaatgccattttcaacgatcctaatgttctgctagtgaaagtgcaacttggcaatctcctttttttnaaaaaagaaacacaatgttctctttttttc

SEQ ID NO: 50799 - DNA, 101 bp, rice(Oryza sativa)
  misc_feature (71): n=a or t
tcaggttgacgccaatatggcaggggcacgggccacctacagttcaatgtatatgcaatgtgattacaaanttaattttgggagacattttgtaatactca

SEQ ID NO: 50800 - DNA, 101 bp, rice(Oryza sativa)
  misc_feature (71): n=a or t
agcctgcaaatgagagtcaatgtagttaggtgggcatacacatacacgtatagacatacgtgtgtgtgtgngtgagagagaaactgtatatgaatgacagc

SEQ ID NO: 50801 - DNA, 101 bp, rice(Oryza sativa)
  misc_feature (71): n=c or g
tacacaagcataaactatccaccaaccatccgaggacagtatggaaagtataatccgaacatattaatagntgaaattcgaatcaaatatttaacattcct

SEQ ID NO: 50802 - DNA, 101 bp, rice(Oryza sativa)
  misc_feature (71): n=a or t
acaggtccgtttagtttgcctttcgtctccttgctttcaaaaagaaaatctatatgcagctgttttttttnaaaaaaaaagatttaaacgaaacaattagc

SEQ ID NO: 50803 - DNA, 101 bp, rice(Oryza sativa)
  misc_feature (71): n=c or g
tttcacaatgaatctaataatgccacttaagtctttttacacatctatggaagacaaaaaagcttcacctnatggatagtgattgagggactacgtgggaa

SEQ ID NO: 50804 - DNA, 101 bp, rice(Oryza sativa)
  misc_feature (71): n=c or g
tcatatgcaggtggcaagtggcgcgacttggagattcagcatggtatgagctcgggtgtgaatcacgtgcntaatctatggacaagcgatgtagataggtt

SEQ ID NO: 50805 - DNA, 101 bp, rice(Oryza sativa)
  misc_feature (71): n=c or g
cacaatataaatctagacttcaatacaacgtaaatttacaaaaaaaccatgcaaaatggaaaattaaatcntagtgccgcggtaaacgacttaactccaat

SEQ ID NO: 50806 - DNA, 101 bp, rice(Oryza sativa)
  misc_feature (71): n=a or t
ggtgacaccaaagccagcactatcctgcattcctactatattccaagttgaaaggttgaacaacacattcntcaactcatcttcacgcaatctcaccttta

SEQ ID NO: 50807 - DNA, 101 bp, rice(Oryza sativa)
  misc_feature (71): n=c or g
tgcgggtggggggtggtttcgacttggcgtggaagtggttgaccaaccgggtcgctgtcgagactcgagancaagagcagagagcggaaccgcgcatgagc

SEQ ID NO: 50808 - DNA, 101 bp, rice(Oryza sativa)
  misc_feature (71): n=a or t
caacttcttcactgcaatttatctggcccttacagcctcttctctgttgcattccaatatgtaaaaaaaanaaaatttagtgcatcagttcctgcatacat

SEQ ID NO: 50809 - DNA, 101 bp, rice(Oryza sativa)
  misc_feature (71): n=a or t
acctttttcaacttatactccctttgcttccgcacatacgttttcaaaattgctaaacattatattttttnaaaaaaatagaaaagttgttttttcaaaaa

SEQ ID NO: 50810 - DNA, 101 bp, rice(Oryza sativa)
  misc_feature (71): n=a or t
gattaaaaaatatcaatatctaaacctgccaaaccctaaaatagtagactatagctaaacaatcaaatgangggtggcacggctccagctacaacttcata

SEQ ID NO: 50811 - DNA, 101 bp, rice(Oryza sativa)
  misc_feature (71): n=a or t
gtgttgcaccatagcaactggtacaccaatgtctaactacaactaccacagggggtgttgcgccatagcanctagtacaccaactctgaattgttgttgtt

SEQ ID NO: 50812 - DNA, 101 bp, rice(Oryza sativa)
  misc_feature (71): n=c or g
cccataatccccctcactttttacacacgccaaaacgaatttcccccatgttccaaacttccaaagcttcncaaataaatccacaagcacaagtctcccct

SEQ ID NO: 50813 - DNA, 101 bp, rice(Oryza sativa)
  misc_feature (71): n=a or t
ctcccaatatcttctgtgcatgtgtgtacattggttgtgggaatcttggatacccacttgatccttttttntcccaaagaaactctttcattcattcaaga

SEQ ID NO: 50814 - DNA, 101 bp, rice(Oryza sativa)
  misc_feature (71): n=c or g
aacacctagagttccatgccctttcgccgccggtaacattgcccaacaagctcgagttgaaggaggagatngcacaggcggcttcaagcgagctcacagtg

SEQ ID NO: 50815 - DNA, 101 bp, rice(Oryza sativa)
  misc_feature (71): n=a or t
aagatagcatagaagagagcaaccttgagatcccgcctgcaacataaaggatcatggatttaagagcaatnacaaaggcctcagaagtcaaaacagaagca

SEQ ID NO: 50816 - DNA, 101 bp, rice(Oryza sativa)
  misc_feature (71): n=a or t
ttgcattataaactatatgtatttactcttgctacctgcatttttttctccttgttaaacatcgttaaacnttgcgttgcaattgcatgttatatgattat

SEQ ID NO: 50817 - DNA, 101 bp, rice(Oryza sativa)
  misc_feature (71): n=a or t
gtttattcctggtaagtgtggttatgagcttgatctgtgggatattatcatcagccagccactagttgacnacaactgtgtgagagaggcatatgttgtca

SEQ ID NO: 50818 - DNA, 101 bp, rice(Oryza sativa)
  misc_feature (71): n=a or t
tccagcaacaacctggaacaagttttaacacccaaagaagttagcagcatacaaaatagattttttttttnttttttttttgagatagcatacaaaatagt

SEQ ID NO: 50819 - DNA, 101 bp, rice(Oryza sativa)
  misc_feature (71): n=a or t
ttaaaaaacaccggcactacttaccagcgcgccatgacagtcgtcttggacgggttattatatgaaattgncgaatgctatatagatgacatcgtcatgaa

SEQ ID NO: 50820 - DNA, 101 bp, rice(Oryza sativa)
  misc_feature (71): n=c or g
taggctataatatctccaccatgataaaaatgatgagccggagagaataagaagagagaacttgagagggngatcatattagcgtcgactgtatttagcct

SEQ ID NO: 50821 - DNA, 101 bp, rice(Oryza sativa)
  misc_feature (71): n=a or t
ccagtgaatatcctgaaagtcattagcatgaattttttatgctccttgtttctcctccgtaatttcaagtnaagatgtgtcttcactcctctggcattttg

SEQ ID NO: 50822 - DNA, 101 bp, rice(Oryza sativa)
  misc_feature (71): n=c or g
agattgatcatcccgtcaccaatcgatcggtcgatctatgatctctctaaacgattgatgagcgaatgtangaagaagcatttcaggaagggatagcactg

SEQ ID NO: 50823 - DNA, 101 bp, rice(Oryza sativa)
  misc_feature (71): n=t or c
ggcatattttgatgatgttgatttggttccaaggaggatagttattaaacagttccctaatcagggtgganagggtgaatcttggacctttggtgtctttg

SEQ ID NO: 50824 - DNA, 101 bp, rice(Oryza sativa)
  misc_feature (71): n=a or c
taggcatggagcttatggaaggatgacaaggccatggatttggtggattcatccattgctgagagttgctnaaaaatggaagttttactatgtatccacat

SEQ ID NO: 50825 - DNA, 101 bp, rice(Oryza sativa)
  misc_feature (71): n=t or c
acgcgcgctgggtgttcgcggcggtggctgcgcggaacatcaccatgtggaccactgtcatgtccgggcanagccagcatgggcgcgtcgcggaggcgctg

SEQ ID NO: 50826 - DNA, 101 bp, rice(Oryza sativa)
  misc_feature (71): n=a or g
caatcgagagcgaactgtttcgatggatcgatttattgggaggatttagaggagagtgtgagatgattccnatactgagattgtgctgtttggtgtgggat

SEQ ID NO: 50827 - DNA, 101 bp, rice(Oryza sativa)
  misc_feature (71): n=a or g
cgctcctctgcctccaccgcccgaagctgccttcgttgccgctgccagaagcccaccatagatgccctctncctcacatcgctgcctgcaggggaggagtg

SEQ ID NO: 50828 - DNA, 101 bp, rice(Oryza sativa)
  misc_feature (71): n=t or c
ccccgatgaggatagacagaaccgtggaattcatcaccgccaccaccggcccataaccccctcctcattcnagcgctgccgcttattcgctcgccgcccta

SEQ ID NO: 50829 - DNA, 101 bp, rice(Oryza sativa)
  misc_feature (71): n=t or c
cccttgagcacgaccttgtcctcaaggtcgaaaatgtggaaacgttgcttgaataaaagcagagtcctccnaagtagcatcctcaggagatagattttccc

SEQ ID NO: 50830 - DNA, 101 bp, rice(Oryza sativa)
  misc_feature (71): n=t or c
aatatgaatgcctctcgagttgtggtattcgtactccatccatgcttcttccggtgcattcttcttccacnaagagctccagaagttgctggtcttctcgt

SEQ ID NO: 50831 - DNA, 101 bp, rice(Oryza sativa)
  misc_feature (71): n=a or c
cgtggggatcggcacgcgcggcaaagtagacgacgccgcgacggctcggtagtagcagctacactaccacngcggcgtgtgctcgtgccgtcgtgccgcgc

SEQ ID NO: 50832 - DNA, 101 bp, rice(Oryza sativa)
  misc_feature (71): n=a or g
tatccgcgttgaccgatcgatcaggtaggtgcggactggactggatggttgaccgtttctaccgatcatcnctgccggcattgcgtccccggaaatctgtt

SEQ ID NO: 50833 - DNA, 101 bp, rice(Oryza sativa)
  misc_feature (71): n=t or g
gacttgaaatgccttggcagaggaagcaacgaagttgctgataccgagaggtgctggcggtgtagttgtcnatggcgtgagttcccacgaagccagcttga

SEQ ID NO: 50834 - DNA, 101 bp, rice(Oryza sativa)
  misc_feature (71): n=a or g
tgcgtagcatggcttcccatttgcaggatgtctgccttcattggccttgaagcggtgagtagccgcatatnctgaaatttacccaagaacaattgtagctc

SEQ ID NO: 50835 - DNA, 101 bp, rice(Oryza sativa)
  misc_feature (71): n=t or c
gcaagcacgagaaagatggggggcaatggaatgaaacagataccataccttaccaggcgggcaacgagcanatggtggcggtgggtgggtggtgtcgcccc

SEQ ID NO: 50836 - DNA, 101 bp, rice(Oryza sativa)
  misc_feature (71): n=a or g
tcggcgcaagcgctgagcgcgacattgaaggcagcgatgttgggaagggaaatattttgatggggagagtnggtaaaggggggctcggcggaggtggcgga

SEQ ID NO: 50837 - DNA, 101 bp, rice(Oryza sativa)
  misc_feature (71): n=a or c
caaacaaagagattgtgagcttcacaaaagagcaagagaaagcacttgaactcatcacctccctccagganctctgcttttttcacaatgagaagctgcag

SEQ ID NO: 50838 - DNA, 101 bp, rice(Oryza sativa)
  misc_feature (71): n=t or c
agtttatcaaactcaattcccttcggatatgtatggaggtgagcaaccgatgacaagttcacaatacgacnttcaatacctgtggacttcgcggttgcttt

SEQ ID NO: 50839 - DNA, 101 bp, rice(Oryza sativa)
  misc_feature (71): n=a or c
ccacaccatcctgtcatcggcgcatctttcttaggcttccaagtactacccgactacttggacgcagtganagcatcttccgctttggcgtattcattggc

SEQ ID NO: 50840 - DNA, 101 bp, rice(Oryza sativa)
  misc_feature (71): n=t or c
tgatcaaccaagccggggatgtcattgtcgtcaagccacttcttgaggccaatcttttcagagtagttgcnattctcgacatgggacttgagggacatgac

SEQ ID NO: 50841 - DNA, 101 bp, rice(Oryza sativa)
  misc_feature (71): n=a or g
aaattaccaaactgatccactgttttccgcactccaaatccaaagcgtagtttttggagcttttgcatggntccttgtgcaaacgccacctccatgttgtt

SEQ ID NO: 50842 - DNA, 101 bp, rice(Oryza sativa)
  misc_feature (71): n=a or g
gccgccgagaagttcatcgactcgaagtcgttcatatccaccaccaccagagctaacagaattacctaccnccgccttaccgtaatcaccaaaaaacgccg

SEQ ID NO: 50843 - DNA, 101 bp, rice(Oryza sativa)
  misc_feature (71): n=t or c
ttctaatctaaagcagtcttcttttgaaagtgactctgcaaactcatggagaagatcatgcatgctgtacngtttactgacatgcatttcagatatgggtt

SEQ ID NO: 50844 - DNA, 101 bp, rice(Oryza sativa)
  misc_feature (71): n=a or g
catctccataggaaaaagaaagagggtaatagagctacctgataggatggcattcgtagagactggtggcngcggcagagggtcacgtcggagcgagagat

SEQ ID NO: 50845 - DNA, 101 bp, rice(Oryza sativa)
  misc_feature (71): n=t or c
ttgtttggttggaagaggaggtgtcttgcactaccatggattactttggcacacttgaggaaactagggcnattcccatgtgtggccaccacatgaagcgc

SEQ ID NO: 50846 - DNA, 101 bp, rice(Oryza sativa)
  misc_feature (71): n=t or c
ctggctctctccggtatcctctttgtgtgtatagcacaccacatatccattgtcctcattaccatccccantatcattgcttggcacgaaaaatggctccc

SEQ ID NO: 50847 - DNA, 101 bp, rice(Oryza sativa)
  misc_feature (71): n=t or c
catgccacggcgtctaacccaatctcctctagtttctcgtggtgcgtattggacaaagcacggcaagcgtncgatgctagtgcggcactacatcgtgtcag

SEQ ID NO: 50848 - DNA, 101 bp, rice(Oryza sativa)
  misc_feature (71): n=a or g
gagctggaacatgaagaggggagaacgcgtggaggtaagggcacagcacgggtggaggcggacgaggactngggcgaaaatgagcattggtggcgcgtagg

SEQ ID NO: 50849 - DNA, 101 bp, rice(Oryza sativa)
  misc_feature (71): n=a or g
tcgctgcttttgtgccttactctcactagacttaaccctcagatcagcgagcctatgcaaagcctcaccgntggagtcactgcgggtccttttggaacccc

SEQ ID NO: 50850 - DNA, 101 bp, rice(Oryza sativa)
  misc_feature (71): n=t or g
acgatgcactaacaacatgcaggaggttctcatttgtaacaagcacaccacgagtacctgaagtaccattnctcatcgcacttcctctagcctggctgttt

SEQ ID NO: 50851 - DNA, 101 bp, rice(Oryza sativa)
  misc_feature (71): n=a or c
aatgtagaataatgtattttactttcgcctctcttgtgaatcatggccgccttacgttttctacgcgactnggcagcaacacatggttgtggccgtggcaa

SEQ ID NO: 50852 - DNA, 101 bp, rice(Oryza sativa)
  misc_feature (71): n=a or g
atccctgatgatctatcgtcactgacagagctcacactgctggacttgtcacaaaataagatgcagggacnaattcccgagtgggtattgaagcaccagaa

SEQ ID NO: 50853 - DNA, 101 bp, rice(Oryza sativa)
  misc_feature (71): n=a or c
cggtattgtctcgttactcttaacaatggtcactctaaaacctcgaaataacaccgggaatgtgacagtgnagcaacccatgccattgcaaatccctcctt

SEQ ID NO: 50854 - DNA, 101 bp, rice(Oryza sativa)
  misc_feature (71): n=t or c
gacggtgactaccccagctggcactcagaaaaccgtcttcggaagtgcgaacttcaacattcgcccggagngctctgacatatggccagtgaacgcgtcca

SEQ ID NO: 50855 - DNA, 101 bp, rice(Oryza sativa)
  misc_feature (71): n=t or c
acgtggttgtatggaaggcggcgtcaaatggcgagttctctgtgcgaacagctagcctactcgctactgtngatcggaaggacggcgtgcccgcttggcag

SEQ ID NO: 50856 - DNA, 101 bp, rice(Oryza sativa)
  misc_feature (71): n=a or g
acggtctgtttagttttgtcatctgatgtacaaatatatgttctgtaggtctgcaagggatggcacagcancacagggcaatctaccttctgctccaaaaa

SEQ ID NO: 50857 - DNA, 101 bp, rice(Oryza sativa)
  misc_feature (71): n=a or g
tattatctttttttcacgtccaatttctttatgggtggttttcctgttctagcagaactaacagatgatgngaaatttctgttggcggctcggaggtgcag

SEQ ID NO: 50858 - DNA, 101 bp, rice(Oryza sativa)
  misc_feature (71): n=t or c
gccactgcccaagcacgccaaatcagaacaaacacttagcgaggtagctaatgtggcatcattaggccttntgttttctcgcaacattgagcggaagcatt

SEQ ID NO: 50859 - DNA, 101 bp, rice(Oryza sativa)
  misc_feature (71): n=t or g
caatgtaaagtggcaacgattagacatggtaggaaaaaaaaatgcatggagcacttcagaaatatgctgcnggcacctacctgtgatagggatactttaga

SEQ ID NO: 50860 - DNA, 101 bp, rice(Oryza sativa)
  misc_feature (71): n=a or g
taatgagacaggaagctggccactcttcccatgcagaagttcagaaaggttcccattggggacaaactcantgaccagcattggagcatctgcctccacac

SEQ ID NO: 50861 - DNA, 101 bp, rice(Oryza sativa)
  misc_feature (71): n=t or c
aagaggtaaggactaagaggatctccctgtctcagccctctagatggtttgaaaggttcaagcagattacngttgaagcgcacactatattgaacaaaagt

SEQ ID NO: 50862 - DNA, 101 bp, rice(Oryza sativa)
  misc_feature (71): n=a or g
cgtatgggagacagggcttgcctctttggagcagatctccataccaacttccaaaatttgtggaaaggggncatttttcacagcatcttcgttggatttac

SEQ ID NO: 50863 - DNA, 101 bp, rice(Oryza sativa)
  misc_feature (71): n=a or g
gatatgaagcagaaataacgagtagtaggggtctgtttgggaaaagaatgactgttgctcctggagtgctngtaagtggtggcagtccaaatgaagaggtt

SEQ ID NO: 50864 - DNA, 101 bp, rice(Oryza sativa)
  misc_feature (71): n=t or c
cgaatcgatgcaaagcagaggaggagaggcgattcccgaattggattcgacctgtgcagagctaattgttnaaagatgagtggcgaggctgtagctgcctg

SEQ ID NO: 50865 - DNA, 101 bp, rice(Oryza sativa)
  misc_feature (71): n=t or g
ttgtcatcaaattacaaaatcgtcctccaaccacaaaaccggagaacgcatcctctaacttacaaaactantataaactagatcccttggcagtttttact

SEQ ID NO: 50866 - DNA, 101 bp, rice(Oryza sativa)
  misc_feature (71): n=t or c
caatcgttgttctaatcgattgatccctcctgttttggatcttttttggcctgccattttggtagggcttnagattccggcagcatgactgatatgtacat

SEQ ID NO: 50867 - DNA, 101 bp, rice(Oryza sativa)
  misc_feature (71): n=a or g
ttcgatcaaatgtactatgcaacaaatagcaagcaggctatgagcaccttgtgtgactgcattgccgatgnggcctactatcgctatcagtaggtgctaag

SEQ ID NO: 50868 - DNA, 101 bp, rice(Oryza sativa)
  misc_feature (71): n=a or g
gcagcattactggtttcagcatccttcgtccatactttattgttgtctagcggccaattagctactcctgngcagtgctgagcttcgacaaactccagcat

SEQ ID NO: 50869 - DNA, 101 bp, rice(Oryza sativa)
  misc_feature (71): n=t or c
gaaggagtacatggcagcggatgaggagaaggagaggatcaaggcgaagaatttgctcgaggaattcttgnagaataaggtagtgtttaaggtagtgtttg

SEQ ID NO: 50870 - DNA, 101 bp, rice(Oryza sativa)
  misc_feature (71): n=a or g
gttgaaatttttactgtaaaaacttgtcattgacttgcacgatcacatcttgtagtaccatttgcattctntcctatcaattcctctgaaaatgtaaatga

SEQ ID NO: 50871 - DNA, 101 bp, rice(Oryza sativa)
  misc_feature (71): n=a or g
tactcctgcaatattgaaatgaatccattagtatttgaggctggggcaatgcaaaatcttgaaaggtttcnctttaacttaaaagcacgagaaacaagaaa

SEQ ID NO: 50872 - DNA, 101 bp, rice(Oryza sativa)
  misc_feature (71): n=a or c
ccccagtgacgaactccatgcttgctagctagctgtggttgacttgacttgagttgagtggatggtattgntgggttggtagctgggtaggagcagaaaca

SEQ ID NO: 50873 - DNA, 101 bp, rice(Oryza sativa)
  misc_feature (71): n=a or g
caaaaggaaaccaaatgttgcagttgttattgctgcaagcgtaattggttttgtgttattaatggtcgggntgtttttactgatttggaggaacagattcg

SEQ ID NO: 50874 - DNA, 101 bp, rice(Oryza sativa)
  misc_feature (71): n=t or c
gctgcagaaaaaatgttgcgtcctgaaaatggtatgtctgaactttgagaagttcaggcttgctcctgacnaaggatctggcttccgtaatcctggttaaa

SEQ ID NO: 50875 - DNA, 101 bp, rice(Oryza sativa)
  misc_feature (71): n=a or g
atttagcactgtttatttttaggccatatggtataacatttgaggatgttttgaaaatggcaggaccatcntccattgaatgcattagggcatctacaaag

SEQ ID NO: 50876 - DNA, 101 bp, rice(Oryza sativa)
  misc_feature (71): n=t or c
ttcgcagcttctgtgtaatggattccatcccaattgacaaattctgtactgtccttgcaccctttggctgntacaagattaccattcagagacgctgtctg

SEQ ID NO: 50877 - DNA, 101 bp, rice(Oryza sativa)
  misc_feature (71): n=t or c
gaagttggtatatgaccttcaaacatattcctcgctaaggaaaggaattggagattagggagcacatcgcnaatgttgggtggcagtgcttctttccctag

SEQ ID NO: 50878 - DNA, 101 bp, rice(Oryza sativa)
  misc_feature (71): n=a or g
gctttcaaagttgagacctttccttacttttccatcagaaaaattgacacgctggctactgtcactgcctncaaacaaatcactgaactgcttaagacctt

SEQ ID NO: 50879 - DNA, 101 bp, rice(Oryza sativa)
  misc_feature (71): n=a or g
aaatatcgtgcgcatatgcaaaacgttgacaatacatgcagcccatatatcgaagattgtgggctacatgnaccgaatcagcacaggtgcaaagctatttc

SEQ ID NO: 50880 - DNA, 101 bp, rice(Oryza sativa)
  misc_feature (71): n=a or g
ccaggcaacattcgagctcatcgatgggagaccaaagcggcaaagaagatgaggtcggagcattggtgtcnagacccgcgacacggtggtggtaggagctc

SEQ ID NO: 50881 - DNA, 101 bp, rice(Oryza sativa)
  misc_feature (71): n=a or g
cgctgcaatggaagcagtgattgtccctgccaaaataccagctaatgcgcccctctttagacctgatgacnccacagttgggaattctgcaaaataaatta

SEQ ID NO: 50882 - DNA, 101 bp, rice(Oryza sativa)
  misc_feature (71): n=a or g
agattgtcctggtcctgcattggttggagaattatttacagtcccagtgaccatattgtcaaaaggacacncagttcattctggtgaactgaaaatcaacc

SEQ ID NO: 50883 - DNA, 101 bp, rice(Oryza sativa)
  misc_feature (71): n=t or c
ggactcatattttggataactctactaggaactctattgatgagataggtggcggcttgaacagcttcatnccaaaattttagaggcattgtggcatggga

SEQ ID NO: 50884 - DNA, 101 bp, rice(Oryza sativa)
  misc_feature (71): n=a or g
tcagcagatgggaatcggaattcagacattcccagaatcccagcaatgaatgcttggatatatgtcaaccnaaactgacctagagatcagctgccttctgg

SEQ ID NO: 50885 - DNA, 101 bp, rice(Oryza sativa)
  misc_feature (71): n=a or g
caactgaacaaagcccagtgcaacaagaattcatgcactcgcctcgtgagggctgtcaaaaatgctcaaanctcgcgagctgctcgagctcggctcgtcta

SEQ ID NO: 50886 - DNA, 101 bp, rice(Oryza sativa)
  misc_feature (71): n=a or g
agctaacaagctatttagatgcactggaatgggtgccaatttcattattgttaccatgattttccagtgtncattcactatatagactgaaatgcatcata

SEQ ID NO: 50887 - DNA, 101 bp, rice(Oryza sativa)
  misc_feature (71): n=t or c
aaattaagcttctcctccccgaaaatctgccacgtgtcttctttctccccgaaagttcgctgtgatggacnaacgaagcttgattttttctcgcaaaagcg

SEQ ID NO: 50888 - DNA, 101 bp, rice(Oryza sativa)
  misc_feature (71): n=a or g
ttttgtagttctaagtttcctactattaacctacttcagccttctccatgaatttcattgcagcttcctcntagcagaatggcaacatctacagaatgatt

SEQ ID NO: 50889 - DNA, 101 bp, rice(Oryza sativa)
  misc_feature (71): n=t or c
aagacgacaccctcggtctggtcctgcacttgtggcttctggcaccatacttctcgtggaaatacagccancagcggcaccactccaacaccagctcacag

SEQ ID NO: 50890 - DNA, 101 bp, rice(Oryza sativa)
  misc_feature (71): n=t or c
tataccaatttacctcatttttttttgttttcattacttttgtttgatggtggagctgactttgcaaggcngactcttaaggaaaagtttttacttaactt

SEQ ID NO: 50891 - DNA, 101 bp, rice(Oryza sativa)
  misc_feature (71): n=a or g
tattcctaaacgtagttctaacacctggatcggcctgcttagttctaatcggttcttgggtactctcatanatccattgtctagcctttatccattgttgc

SEQ ID NO: 50892 - DNA, 101 bp, rice(Oryza sativa)
  misc_feature (71): n=t or c
atgcagcagcaagactgatatgattctcctgacttagcagcttgcatactgttgctccttcgatgattgtngtttattttctttatcagcttaagctttta

SEQ ID NO: 50893 - DNA, 101 bp, rice(Oryza sativa)
  misc_feature (71): n=a or g
aaacactgtcatatagttgaggtaggacttgcattgctagcttactcatctatgccacttaaattttggantgaagcctttctttcagcggtctatttgat

SEQ ID NO: 50894 - DNA, 101 bp, rice(Oryza sativa)
  misc_feature (71): n=t or c
gagattggatactactatgtgaatgctatagaaaacttcctatagatcacatttaccaggaaatgtgctcnaatgattgaaaaagaagtttcaatccttgg

SEQ ID NO: 50895 - DNA, 101 bp, rice(Oryza sativa)
  misc_feature (71): n=t or c
atcaattcccaggttctcgctgattttatagctgactggactatgtctgagaacaggccaaacagtcaaanagacagcgaaacgtggacaatggcgttcga

SEQ ID NO: 50896 - DNA, 101 bp, rice(Oryza sativa)
  misc_feature (71): n=a or c
gtccaggtctagtggaaagggaggattttcggatttctaccgactcatacactagtgttcctcgcagaatnaaccacacacaggagtagggttttacactc

SEQ ID NO: 50897 - DNA, 101 bp, rice(Oryza sativa)
  misc_feature (71): n=t or g
gggtggctatggctccgtgttcaagggagtgatactgcctggtgatgtccatgttgccatcaaaatgctanccaactacaattgtaatggagaagaattca

SEQ ID NO: 50898 - DNA, 101 bp, rice(Oryza sativa)
  misc_feature (71): n=t or c
gtatttctacatgtttgacaggtatattgtgcaagcatgctctccgagtctttaatatcaatgaggttttnatctttccgaatctttaatatcaatgaggt

SEQ ID NO: 50899 - DNA, 101 bp, rice(Oryza sativa)
  misc_feature (71): n=t or c
aagaaaaaacatatgaaaaaaacccggaataaaggcaaaaaaaaagtaaaaagcagatcggttttttcccnggtttttttctgtccgagtggtttttttag

SEQ ID NO: 50900 - DNA, 101 bp, rice(Oryza sativa)
  misc_feature (71): n=t or c
agcagagtactttgactttgcttgaagtgtttttacttatatttttaaggggcaattgcatccatgccctnattttgaatgtcaactgctattttacccct

SEQ ID NO: 50901 - DNA, 101 bp, rice(Oryza sativa)
  misc_feature (71): n=t or c
tcgtggcactgtgaaaggccttagcagtttagcacgtggcatttatatcaaacatgcatgtactactcccntcggacggaaataaatgacgtttcagacag

SEQ ID NO: 50902 - DNA, 101 bp, rice(Oryza sativa)
  misc_feature (71): n=t or g
tgtaccttcattttgtcttccagcagacgagtaaagtatttctggagttcagatccacggaaattcctcanaatttcatcccaatttgggggatcctgcaa

SEQ ID NO: 50903 - DNA, 101 bp, rice(Oryza sativa)
  misc_feature (71): n=a or g
atgtccgggagagacgaccagacataccaactcctccttcggatgtccctggaccgggagagcttgggccngcaataccaccactcgccgccgtcctacag

SEQ ID NO: 50904 - DNA, 101 bp, rice(Oryza sativa)
  misc_feature (71): n=t or c
actgaagaacatccaaaagttcagagaagctagctgagcacaatctttgcttaccgttgatccagttcatngggggctggaagtggtatcctgtcctgagc

SEQ ID NO: 50905 - DNA, 101 bp, rice(Oryza sativa)
  misc_feature (71): n=t or c
tcctttttcatgacttacccaagagggcaactgaggccaaaagatacttcacacacttcttaagggcattnccaacccaatgactaggatagtgtccatag

SEQ ID NO: 50906 - DNA, 101 bp, rice(Oryza sativa)
  misc_feature (71): n=a or c
tgtatcttcttgtcctctgtgtgcttatggtagaccctttgattcatgtggagtatatgtgcattacctcnccctgtttatttctgtttcttgaaagtaat

SEQ ID NO: 50907 - DNA, 101 bp, rice(Oryza sativa)
  misc_feature (71): n=t or c
agataaaattaaaacacaaagtaaaccctaacccatctcaacaaatccacaacgaacgtatcgttcccaanagcagcggctcaccatagtgcattagtgtg

SEQ ID NO: 50908 - DNA, 101 bp, rice(Oryza sativa)
  misc_feature (71): n=t or c
cttcttccgatttttagaagctagctaccaaccagcatattcttcccaaacaggacctaaagcgatactancactctaatcttcagaacacgattaacgct

SEQ ID NO: 50909 - DNA, 101 bp, rice(Oryza sativa)
  misc_feature (71): n=a or g
tcaacttcccaagtacctcaagttcatgagcaaccttcccttggctcccaatttggaatatcttgtcactncaattaatctgttttaaagaataggttgag

SEQ ID NO: 50910 - DNA, 101 bp, rice(Oryza sativa)
  misc_feature (71): n=a or c
tacaacccgttagagataaaaaaaacatacctctaacgggttattctctctacctgtcgctgatgaggccnaactcgtcatcgctgcattatatttttaat

SEQ ID NO: 50911 - DNA, 101 bp, rice(Oryza sativa)
  misc_feature (71): n=t or c
tcattgctgcaaatgaaagaggaaaaaaaatgtgggctactaaccctctgggccacaatagacattagcanccttactcaaaagtgcattagtgctaagct

SEQ ID NO: 50912 - DNA, 101 bp, rice(Oryza sativa)
  misc_feature (71): n=a or g
caccgacgccaagtgtcactgctgtaagaggaagaggctaaagggcatgatgcctaattggtggtggattngaggggcgaagttgcggccaggacgcagag

SEQ ID NO: 50913 - DNA, 101 bp, rice(Oryza sativa)
  misc_feature (71): n=a or g
agaatgtacaaaatcttctctaacgctatcgcagttagctactcacacctgcttccagtagtgccatacantgctttcaaccctcctccaccagtatgtaa

SEQ ID NO: 50914 - DNA, 101 bp, rice(Oryza sativa)
  misc_feature (71): n=t or g
agatttgtgtcgcattactgacgatcgatgatgcctgatcccctcctctgtcattgcatctatgatccagnacccaaacaaaatttttcaccctatcacat

SEQ ID NO: 50915 - DNA, 101 bp, rice(Oryza sativa)
  misc_feature (71): n=t or c
tcctaggtagacaagaagttgttgacaaggtacttcaaagcacatccacatgataatctaccagcatccgntgataaggtatcattcttttactttcaaga

SEQ ID NO: 50916 - DNA, 101 bp, rice(Oryza sativa)
  misc_feature (71): n=a or g
tattcgggatattataaatgatcttcggaaaaggaagttgaagttaagaccagttacgtacctaagtagcncacatgcttattcaaatgatattcctcatg

SEQ ID NO: 50917 - DNA, 101 bp, rice(Oryza sativa)
  misc_feature (71): n=a or g
taacctacatgcccatgaagggaagtggggaagtgcagcggtggtaagggaagagatggaacggcaaggcntttacaagcagccaggatacagctggattg

SEQ ID NO: 50918 - DNA, 101 bp, rice(Oryza sativa)
  misc_feature (71): n=t or c
ggccgtgtctagcacgttaagcaaagatagattataagatatcgtctatggaccgagatggaactaaactngacttccacacgcatgaaagatattttttt

SEQ ID NO: 50919 - DNA, 101 bp, rice(Oryza sativa)
  misc_feature (71): n=a or g
acgacaatgatggtggcgcctcgacgcattcccgaacacgatacgatggaggaaggtggcagccagcatgnggattgagggaagagttgggaacgccgacg

SEQ ID NO: 50920 - DNA, 101 bp, rice(Oryza sativa)
  misc_feature (71): n=a or c
tttttttcgtgccaaaaatattttgtgtcgcaggtgggttaagcatttcgtctgttaatattgattttggnaaatgttgctttttagatacctgtcagtaa

SEQ ID NO: 50921 - DNA, 101 bp, rice(Oryza sativa)
  misc_feature (71): n=t or g
aacaaacaactcaaattataaatttaagaggttatttacgtacggacccatcttcaataccacactatcgnaaaaactcaaccttcttgtctagcaataag

SEQ ID NO: 50922 - DNA, 101 bp, rice(Oryza sativa)
  misc_feature (71): n=a or g
aagataggtaaatacaccaaccttaacagagtggctgtcaagctgaatagctgttctacaatcttcctcanccctaacccactcactgcaaaactcagatt

SEQ ID NO: 50923 - DNA, 101 bp, rice(Oryza sativa)
  misc_feature (71): n=t or c
ttggaacgctgtaattgatctgtacacttgctctaattcgtttcacttgtcatggaattatcatgagtacnaaattttatgttaaaaaaagtggtacctcc

SEQ ID NO: 50924 - DNA, 101 bp, rice(Oryza sativa)
  misc_feature (71): n=a or g
caactcctcatcttccacctcctcttcatcttccaactccaactccaactccactagacgctgctcctccnaaataatcttgccgctcatcatcttcaact

SEQ ID NO: 50925 - DNA, 101 bp, rice(Oryza sativa)
  misc_feature (71): n=t or c
tgcaactttgcaaactctttcagcctcttccaaactgaagtcgtcatgtaatcgtggatccatcaaactangcacatctcccacatgaagcttgttaattg

SEQ ID NO: 50926 - DNA, 101 bp, rice(Oryza sativa)
  misc_feature (71): n=t or c
accaatttgttgtgcctcactagcagaatacaaagtctgaactgatcgattggcttgaactttgtaccttntttggttacttcgctgagaaacatagacaa

SEQ ID NO: 50927 - DNA, 101 bp, rice(Oryza sativa)
  misc_feature (71): n=a or g
ggctcttttgcataacggtccccatttgttctagatcgtaacaatcgatagctgttcatagttttacatgntactccatccgttccacgttttacttttgt

SEQ ID NO: 50928 - DNA, 101 bp, rice(Oryza sativa)
  misc_feature (71): n=a or g
gcgattccatcctccaacctctgcttaagcctgaagtgtgctgccctgattgagtttccgaaaaagtaganttattcaatttaagtggagcatttggtata

SEQ ID NO: 50929 - DNA, 101 bp, rice(Oryza sativa)
  misc_feature (71): n=a or g
gttcaattgttcaaaactggcagaaagaacgagaactgatcatttataggcctacacaaacgaatcggctntgtgcatcttagttatgcagaggccggaag

SEQ ID NO: 50930 - DNA, 101 bp, rice(Oryza sativa)
  misc_feature (71): n=t or c
caagacagccaatgccatcagctgagttaactagttcagatgccacggaattctaattttgatccatggcnatccaattcacagcaaaggaaactagcaga

SEQ ID NO: 50931 - DNA, 101 bp, rice(Oryza sativa)
  misc_feature (71): n=a or g
cgcaataataaaattacctccacaagtctatttactggagtcacaacactttgtccaatagctggcctgtntaaagcgctatagccataccgagtggcttg

SEQ ID NO: 50932 - DNA, 101 bp, rice(Oryza sativa)
  misc_feature (71): n=a or g
acaaccaacagtgacatagtagagtatcattcttggcagcaccagtgatagctcaaaatgtgatagtgatnctggaaatgaaccaactggaatgcttactt

SEQ ID NO: 50933 - DNA, 101 bp, rice(Oryza sativa)
  misc_feature (71): n=a or g
ttaccaaactcattggcagaattggattacatctcgtactgcctaaccttttggtataaagagatcgattnggggcttcttgggatacgctctttgtttcc

SEQ ID NO: 50934 - DNA, 101 bp, rice(Oryza sativa)
  misc_feature (71): n=a or c
ttttcaagagaattaatcccaaaatatctcacatctccttcagaacattacgagagcaatcaaagagccanaatgtccatccaccacttcagttatgattt

SEQ ID NO: 50935 - DNA, 101 bp, rice(Oryza sativa)
  misc_feature (71): n=a or g
acatatagccacatcatatttatgcttatgtggaggagaggagaaaaggcatgctacaggtttatagccanctgcagcacaaattctaataagccatgaga

SEQ ID NO: 50936 - DNA, 101 bp, rice(Oryza sativa)
  misc_feature (71): n=a or g
tctgccgattatattagaagaagtaaataaaagaagaatagggtggtttagacgaatacaggttgaagagnttacaacttcgggggaagaaggatggggta

SEQ ID NO: 50937 - DNA, 101 bp, rice(Oryza sativa)
  misc_feature (71): n=a or g
caccagagtaccagccggagaggtgtcttgcaatgtttgggagatggatttcagagaaatcactttgacgnttgtgtatatcagttatgatgagagctgct

SEQ ID NO: 50938 - DNA, 101 bp, rice(Oryza sativa)
  misc_feature (71): n=a or g
cgctgaatgcacgttggcacgccgactcagtctctcgtccgcggtgacacgatattctgcgccaattgacntagcactgaggtgtctaagtttagcgacat

SEQ ID NO: 50939 - DNA, 101 bp, rice(Oryza sativa)
  misc_feature (71): n=t or c
gcggcagccatggcaggcaatgaggaagacacagtggatttcttctcccagtcgtacacacatcacctggnggccgccatcgacgccttcaagtatggctt

SEQ ID NO: 50940 - DNA, 101 bp, rice(Oryza sativa)
  misc_feature (71): n=t or c
agttctcgcaaggcctcaggattatctgtcaaaaatttgagcatcccagttattccggatgatgtggtgtngaagctgccaaacagaagcgaaaagagcaa

SEQ ID NO: 50941 - DNA, 101 bp, rice(Oryza sativa)
  misc_feature (71): n=t or c
cctatctcggcaaggctcctacggctgagttctttttgttcactttttaactcaccaccatcgtttttcangcgcttttcaaactattaaatggtatgttt

SEQ ID NO: 50942 - DNA, 101 bp, rice(Oryza sativa)
  misc_feature (71): n=a or g
aacttggacgcaaatcagacatgcaagtattctgtatatcacctctggtttttatccattactgggcattncacctatagattactcttggtctacttgtc

SEQ ID NO: 50943 - DNA, 101 bp, rice(Oryza sativa)
  misc_feature (71): n=a or c
taatataatacataattacaatagtataagcactttccagctccatcgtttcaattattcggcgaataagnaaaacaacatatttgcaaaagaaaaatatt

SEQ ID NO: 50944 - DNA, 101 bp, rice(Oryza sativa)
  misc_feature (71): n=a or g
ccaagcgtcagttcaaagggtagaattcaacaagcacaaccgatgctcatctggttgtcttgtttagctgngcatcctgcttgtcaaagctaacagttctt

SEQ ID NO: 50945 - DNA, 101 bp, rice(Oryza sativa)
  misc_feature (71): n=t or c
ggtgctttcttaaaggccctgaacataatgagtgagcggatatgggattgattactcacaagtttctgcanttcttgatcttccaaattactagcttgcaa

SEQ ID NO: 50946 - DNA, 101 bp, rice(Oryza sativa)
  misc_feature (71): n=t or c
tggaagcaggggccacgatgacttgtcgttacttcctaattaagcaggtaatgcaagctttcatcgtcatnattttgtcagattccttatgttccgaacaa

SEQ ID NO: 50947 - DNA, 101 bp, rice(Oryza sativa)
  misc_feature (71): n=t or c
caggtttcgttgttttctgctaagattatcatgtccctttttatgctgtaggacaataggagacatttggnatcccttatcttgtgtattcttaggaattg

SEQ ID NO: 50948 - DNA, 101 bp, rice(Oryza sativa)
  misc_feature (71): n=t or c
attggtttccaccaaaatgacactgcatttgacagagcacagaaatggttggattgttgcctacctcttcnatcacggtttcagtttccataagtgcataa

SEQ ID NO: 50949 - DNA, 101 bp, rice(Oryza sativa)
  misc_feature (71): n=a or g
atctaacagatatgttgtgtatcgccagaagacttggtgaagaagtgaatgatatgtaagaatcctggatntgttgaggaggttggtggagcaatctagcg

SEQ ID NO: 50950 - DNA, 101 bp, rice(Oryza sativa)
  misc_feature (71): n=a or g
tctatgcgatctagggaaagggcaaagttgcacgggttgaaaaatatagggtcaaaatacaacaacaatcnagaatataaatgttctttcgcgctagagtt

SEQ ID NO: 50951 - DNA, 101 bp, rice(Oryza sativa)
  misc_feature (71): n=a or c
ccatcgctagctggtgagctcacatttctaacatgtcaatctacgttcagtcatgcaaataatctactccntccatccccaaaatgtttgacaccgttgac

SEQ ID NO: 50952 - DNA, 101 bp, rice(Oryza sativa)
  misc_feature (71): n=a or c
cctccatggcctcatcatatttccatgatacttccaattcctagttgtcgtcatagtcggggtcactaaancttcatcccatccactgtcagctgccaaac

SEQ ID NO: 50953 - DNA, 101 bp, rice(Oryza sativa)
  misc_feature (71): n=a or g
aactggtatgcaaattttaaataagagacatgtatttgacaaaattggttaaagcactgaaagagtggaanttcacgactttagagaacttgaatatttaa

SEQ ID NO: 50954 - DNA, 101 bp, rice(Oryza sativa)
  misc_feature (71): n=a or g
ggctcggtggagtggtggagatggggaaagtacgaatgagttgttgataggtggggatgggggtgcgattnttaattgttctcagcattggggcagaaatg

SEQ ID NO: 50955 - DNA, 101 bp, rice(Oryza sativa)
  misc_feature (71): n=t or c
gtacatccgattctggtggtggtgtgcactgctgttccattcagatgcctctggcttctcggtcttcttcnccgcgggctgcgcagcttcagtggtggcct

SEQ ID NO: 50956 - DNA, 101 bp, rice(Oryza sativa)
  misc_feature (71): n=a or g
tagaacttccaagttccaaacattgatgacatgtctgaattccgttcacttctcaacaccataagccacanttcaggatcaaagcaaaaatggaatatcta

SEQ ID NO: 50957 - DNA, 101 bp, rice(Oryza sativa)
  misc_feature (71): n=a or g
aactctaagggcggtgaggaggtagattggttgggccgttaagactgacttgacgagcgtggctcttccanccggccccatgttctttgtagcgcccgttc

SEQ ID NO: 50958 - DNA, 101 bp, rice(Oryza sativa)
  misc_feature (71): n=a or g
gtcccagataataacgtcattccagccaacctctactgatcccctgcatatgcatatcgatcgattgatcnactactcaatctgtcaactatcaaataatt

SEQ ID NO: 50959 - DNA, 101 bp, rice(Oryza sativa)
  misc_feature (71): n=a or g
ctcttgaaaacagtatataggaacaccctgcattagggatagttatcatcaaaagatgatttgctgtaccnagccagcttgcaaatgcaaggtactgcaac

SEQ ID NO: 50960 - DNA, 101 bp, rice(Oryza sativa)
  misc_feature (71): n=a or g
tacagattgtaacaatagttcccgatatgataaattgttacatcgaatgccagagtgtggccatttggccntttggcaaaaaaaacatgaaataggaaaat

SEQ ID NO: 50961 - DNA, 101 bp, rice(Oryza sativa)
  misc_feature (71): n=t or g
cttggtctacaggtaccaaatccttaccattgctcatgtgatatgcccccatcagcatacatttaaaccancatgatgtttaattaattaatcactattgt

SEQ ID NO: 50962 - DNA, 101 bp, rice(Oryza sativa)
  misc_feature (71): n=a or g
tgattttagaccaattagcctcattcactctgtggctaagctgatatccaaagtgccggcgatgagacctnctaaacagctagatggcctgatctcggttg

SEQ ID NO: 50963 - DNA, 101 bp, rice(Oryza sativa)
  misc_feature (71): n=t or c
agtgtttgtgtgatgtaactaatatgtgtaagtttataatccttagttgtacacttatctgtagactgcanttgttaatttttgttacacatatatcaaaa

SEQ ID NO: 50964 - DNA, 101 bp, rice(Oryza sativa)
  misc_feature (71): n=a or c
cgtagttagggccaggatcaggggcccggaagattttggcgatgacaccgtccacactgccggagtagagngagtaggtgcgctcgccgtacttgatgacg

SEQ ID NO: 50965 - DNA, 101 bp, rice(Oryza sativa)
  misc_feature (71): n=a or g
gcataatctgcaatggcctgaccatctgtccagaagaaattacaaattcgaccatcctctttgtccaactncacagaataaaagaaagaagggtcttctgc

SEQ ID NO: 50966 - DNA, 101 bp, rice(Oryza sativa)
  misc_feature (71): n=a or c
gggaatgcacaccttgttgactcaaagcagacaacagatagtccaaaagatgacttgagcattctgacagngtgcttaaggtgcttcctaaaactttctta

SEQ ID NO: 50967 - DNA, 101 bp, rice(Oryza sativa)
  misc_feature (71): n=a or g
taccaccattattgggcgtcatcgtcttcacttctggtcatattgtctaccgccgactgattatctcgccnccatggctgcacaactccgtcgtcactgct

SEQ ID NO: 50968 - DNA, 101 bp, rice(Oryza sativa)
  misc_feature (71): n=a or g
gccaagattagaaagggactaatttacaagctcgaaggagctgcgatcctagctgatggtaatatgatccnctagtctctcctcgtcatcttcggttccat

SEQ ID NO: 50969 - DNA, 101 bp, rice(Oryza sativa)
  misc_feature (71): n=t or c
aatcgcatccctcaatcgtaaaaccgggcataatgcctccccgagcttcaaaaaatggtgcaaattgactnctttggtggttttgaaagcgatttatgttg

SEQ ID NO: 50970 - DNA, 101 bp, rice(Oryza sativa)
  misc_feature (71): n=a or g
actactttcatgtactctctgtgtaaaaaatcaacttctatctacaattctactatggtccccatcgtttngcatattcatatgcttatcagccaaaattt

SEQ ID NO: 50971 - DNA, 101 bp, rice(Oryza sativa)
  misc_feature (71): n=a or c
ctgtgcagcagctgtgctacagtgcatgatagagaaagtatataaggctggctgtacagcgcagccgttanagctgcatagcagcattgccgaatagaccc

SEQ ID NO: 50972 - DNA, 101 bp, rice(Oryza sativa)
  misc_feature (71): n=a or g
gagagcttgaggtgcacggtggatgcccgtcccacgcatgtgtctgtctatgacttgcagatcgagcaggnaactaagtttgggcaactgtaagtgtttat

SEQ ID NO: 50973 - DNA, 101 bp, rice(Oryza sativa)
  misc_feature (71): n=a or c
aatttttaccgatcacaaggggatagaagaatattagggacagattctgcgagataatccaaggtgtgagnctttttactctggattctcctccctgggcg

SEQ ID NO: 50974 - DNA, 101 bp, rice(Oryza sativa)
  misc_feature (71): n=t or g
cagcctgcaaagcttttgaccaaaggtcacctcttgcactgaggtttgttagctgctatgttgtggttagnaagaagtttgagcagttgaaaccttgtatg

SEQ ID NO: 50975 - DNA, 101 bp, rice(Oryza sativa)
  misc_feature (71): n=t or c
gagaagaatatcggtatatgtattgacgtcaaacttaaaacaacgtggcttgctcatcaatgttaccaaangcatatatatgcatacggaagtaccaatta

SEQ ID NO: 50976 - DNA, 101 bp, rice(Oryza sativa)
  misc_feature (71): n=a or g
catctgaaatgatcaagccgtgaccaaagtatggattacgacgagtaatccgttaatcgcgaaaggcatanacaatagcaacagatgttgtgcttgcacga

SEQ ID NO: 50977 - DNA, 101 bp, rice(Oryza sativa)
  misc_feature (71): n=a or c
cttttgaaatgacgcattcaggaatgttacaacaccaagaaagccaccatcgttcgtcttgaaactaagangtggttttcacttgaagagatccaccagaa

SEQ ID NO: 50978 - DNA, 101 bp, rice(Oryza sativa)
  misc_feature (71): n=t or c
tactaaacgtaacactgaaagccttaaaagacaataaccttgtgtgagtacagttattcgcaacgtatcanaattacataacaataatggaacaaataata

SEQ ID NO: 50979 - DNA, 101 bp, rice(Oryza sativa)
  misc_feature (71): n=t or c
gtattgcatcaggcctcctcttcctcttgtcttccatccccaccacgcgtgcgagacgagaccagcgcgangacggccatggccgcggcggcgacggcggc

SEQ ID NO: 50980 - DNA, 101 bp, rice(Oryza sativa)
  misc_feature (71): n=a or g
cagaacaagatgttagctttctatacctatggatccacatccactgtattgtggtccatgtacaagtgggnttaaaatatttttctgccgttgacagaact

SEQ ID NO: 50981 - DNA, 101 bp, rice(Oryza sativa)
  misc_feature (71): n=t or c
tgtaaaaataagggacctagtatgcattttttttcaggagaagagtggaggggtataagaagtggacgctnttgcacgggctgaaagagtaagagctttgg

SEQ ID NO: 50982 - DNA, 101 bp, rice(Oryza sativa)
  misc_feature (71): n=t or c
agggagtagggcatagctacacgcctaagtaaaaatagaattataactactcccttctcttcaaattagtnatagttctagatttatcctaagtcaaatta

SEQ ID NO: 50983 - DNA, 101 bp, rice(Oryza sativa)
  misc_feature (71): n=t or c
tgtgggaggagtgctcgatggagctctgggaggttgcggcagcacttgtgaaaatccatgggaacaaacangtgcggcagtggagccaagtggtacagggc

SEQ ID NO: 50984 - DNA, 101 bp, rice(Oryza sativa)
  misc_feature (71): n=a or c
aaagatgcattggatcgacaatgtttgcaacttcacttcgaaagggaagtttgaaccctcacccctccccncagtacacgaacaatttcgtcagaaattct

SEQ ID NO: 50985 - DNA, 101 bp, rice(Oryza sativa)
  misc_feature (71): n=a or g
ggaggtctctctattcttcctccttgcgttggacttttccatgtagtactcgtgtaactccttgcattcanggcccatcttgaataaggcatcgtctccga

SEQ ID NO: 50986 - DNA, 101 bp, rice(Oryza sativa)
  misc_feature (71): n=t or c
ccaagttgctattgtttggagtgcaccagtttctctataaaatgggctgatcgatctcccaaggttagctntgcaggaagagcttggtcctaccacagagc

SEQ ID NO: 50987 - DNA, 101 bp, rice(Oryza sativa)
  misc_feature (71): n=a or g
gatactcggaagcaaaaggggaatacaacggtcagtagttcttgttgggcacgaagaaatcgaacgtaacntcgacgctgcctgatgtttctccagtgtcc

SEQ ID NO: 50988 - DNA, 101 bp, rice(Oryza sativa)
  misc_feature (71): n=a or g
tccatgtagatgcactgttttcaccccttatgaaacaatattacttagcaaaagaatattttagttcttgnaaatagtgaaacacaatcgaatcactagat

SEQ ID NO: 50989 - DNA, 101 bp, rice(Oryza sativa)
  misc_feature (71): n=a or g
tgtacggcatcgatctgtggagcaaactttggagttaccacgcatttcggccgttggtaatccgatgcaantttgggtcttgctatttgctactccctcta

SEQ ID NO: 50990 - DNA, 101 bp, rice(Oryza sativa)
  misc_feature (71): n=t or c
cttgattcaatggctgatctgaagactgataagtgctctccagtcaaaaaccaaaatacaggagcgattancagctagagaagattgttgtagagtacgaa

SEQ ID NO: 50991 - DNA, 101 bp, rice(Oryza sativa)
  misc_feature (71): n=a or c
gacttgtggagatctctcgacatgacgcgccataaggtgatcttcaagaagaccatcggtgtcatgtgcgngatggctagggtggctgtggatcggtctgc

SEQ ID NO: 50992 - DNA, 101 bp, rice(Oryza sativa)
  misc_feature (71): n=t or c
catttgtggacaaatccatcacaacaaaactagcatgttgaatcaccctcacttcacggctcacaaaattnattttttttgaacgactcgcacgagacgat

SEQ ID NO: 50993 - DNA, 101 bp, rice(Oryza sativa)
  misc_feature (71): n=t or g
gaaattcactgggtttcgacttcgtctcctcatcgtcgaaacggcctttcactccaattggttatttttcngaggtatccagctttatttctcgaatctcc

SEQ ID NO: 50994 - DNA, 101 bp, rice(Oryza sativa)
  misc_feature (71): n=t or c
acgctcgccgccgccgccgtgtaggtctagggttttgttgttcactgcacactcggtgggcaggagaggantcaatccctatctattcactgcacactttt

SEQ ID NO: 50995 - DNA, 101 bp, rice(Oryza sativa)
  misc_feature (71): n=a or c
tgacattatggtctgaagttacacttacatgtgactttacgttcttctgtggttcttgtttactgctgganaaactttcactaactactggagaggaagca

SEQ ID NO: 50996 - DNA, 101 bp, rice(Oryza sativa)
  misc_feature (71): n=t or c
cagagttcgcacgggcgcctgccatgtcctcgcctgcgtgaagatcgctcatcctgaggtcgacctggagnaggccatggcgaagggaggagctgatgaca

SEQ ID NO: 50997 - DNA, 101 bp, rice(Oryza sativa)
  misc_feature (71): n=t or g
aagcctggcagatggaaaacatcccatggaacagcagtgagtttcgttttcatgtccattgtttccaaganttgtagccctcgcatttggtttggtagttc

SEQ ID NO: 50998 - DNA, 101 bp, rice(Oryza sativa)
  misc_feature (71): n=a or g
tgttgggagtgaacactaatcaatagtacataaatgctgcaatttataatcatgcctatgatcgttggtgntaatctcccattaatcatattacattctgg

SEQ ID NO: 50999 - DNA, 101 bp, rice(Oryza sativa)
  misc_feature (71): n=a or g
agaagtaacgaggaaataacgactaacaagaaacatactttaatttgccatttgatcatcatcatcatgtntggccaattgggcgtcgttgtttgagttaa

SEQ ID NO: 51000 - DNA, 101 bp, rice(Oryza sativa)
  misc_feature (71): n=a or g
taatgaaataaattcattgtcaatcgggaagccttaagttaatagttacatgttctaattgcttcgccttntgacccttatacaatttaaattttctttcg

SEQ ID NO: 51001 - DNA, 101 bp, rice(Oryza sativa)
  misc_feature (71): n=t or c
tgaaaatgatatcatcttctgtcctttgcaccgtaggaaaacatggacaccaattctccaatgatcttacnttttcagttatctttatttgtcgccagaaa

SEQ ID NO: 51002 - DNA, 101 bp, rice(Oryza sativa)
  misc_feature (71): n=t or c
cacctatgggcaaagccaacagcagccgttcatgcaaccgatcatgaactcgtgcaatgagttcgtgaggngacagtgcagcccagtgagcctgccttggg

SEQ ID NO: 51003 - DNA, 101 bp, rice(Oryza sativa)
  misc_feature (71): n=a or g
atccacatgtcgacttgggcaccatccatgtccttgaaaccatcaaagctgaacctgcactcatccagagnaccctgctttcggctgagcagcaggtggtt

SEQ ID NO: 51004 - DNA, 101 bp, rice(Oryza sativa)
  misc_feature (71): n=a or g
gtagaacaggacgacgcgctcgttcatataggccacaaatcgcagtaagctttgtgaagtgcacgatagcntcgtccgttgtgtgactcatcagatcgagc

SEQ ID NO: 51005 - DNA, 101 bp, rice(Oryza sativa)
  misc_feature (71): n=a or c
ttacttatttacctcgttttaaagcttgactactaatttagcctgattttttaaagtttgcacatttgacnatttttcctaaaaatgaatatcaggtctaa

SEQ ID NO: 51006 - DNA, 101 bp, rice(Oryza sativa)
  misc_feature (71): n=a or g
tactttatgcttttttaaagtaaattggcatttgcttctaatatacataggagactgtcaaaaaaagctcnaggctggcaagctgttcgagctcaacttgt

SEQ ID NO: 51007 - DNA, 101 bp, rice(Oryza sativa)
  misc_feature (71): n=t or c
acgaacagacgacgaggcagtgtcaagcaacagtttactgccaatatgcattctggctgtgtgtttagttncacgctaaaattaaaagttagaagaaatta

SEQ ID NO: 51008 - DNA, 101 bp, rice(Oryza sativa)
  misc_feature (71): n=t or c
ttgactttcctatcctcaacattcttatatagattattgttgcttaagtattagatgcggccattatctcnatccctcgttagacgctaaggtggagtgct

SEQ ID NO: 51009 - DNA, 101 bp, rice(Oryza sativa)
  misc_feature (71): n=t or c
acgccacgagctagtcaatcaatggccagggattagaataatcgatgactaggttccagtactgtaccaancaattctctactgaattccaaattctcaat

SEQ ID NO: 51010 - DNA, 101 bp, rice(Oryza sativa)
  misc_feature (71): n=t or c
ttcttcatttgatgatacccatgagtttagtgaccaagaagtttctcctgtggtttctagaggaagacccnggaaggctatgtatcgtgatcatgtgacag

SEQ ID NO: 51011 - DNA, 101 bp, rice(Oryza sativa)
  misc_feature (71): n=a or g
catgtggcacggtggtgagaacacgaaaaggacaagatggcaaagagaggtggtcggtggagcagggctcngtggggacgaattgatccatcgggagggag

SEQ ID NO: 51012 - DNA, 101 bp, rice(Oryza sativa)
  misc_feature (71): n=t or c
aacccgtacgtactaaaattgtcgcccaaaactcattcagacttcgttttcgatgccatacatatacatanatacatacatacatacatacatacatacat

SEQ ID NO: 51013 - DNA, 101 bp, rice(Oryza sativa)
  misc_feature (71): n=t or g
gagcttatgcgggttatgaaaggggataaacagattgtgaactgtgttgagcagcacccttatgggattgntattgcaaactgtggcattgataaagatat

SEQ ID NO: 51014 - DNA, 101 bp, rice(Oryza sativa)
  misc_feature (71): n=a or c
caccaagattgatagtaagatgaaggtgcaaaaaaataaggcgaacgaacacaccgcaaggtgttttgatnagcagaaaaagacatacgaggtcacagaga

SEQ ID NO: 51015 - DNA, 101 bp, rice(Oryza sativa)
  misc_feature (71): n=a or g
aatgcatatttagtttgttgattatttgattatttcttcaacttgttttggaaggtctccttatatgtacnggacgtcttactgtgacatatttcacaaag

SEQ ID NO: 51016 - DNA, 101 bp, rice(Oryza sativa)
  misc_feature (71): n=a or g
accaaggcgatgggaaatcgcactccgtatgaagcgtggatggttaagaagccgcacttggcgcatttgcnggcgcatttgcgtgtgttcgggtgtactgc

SEQ ID NO: 51017 - DNA, 101 bp, rice(Oryza sativa)
  misc_feature (71): n=a or g
ttggtttggtaggaatttcaacattacatgcaaggttttaagaacgccgcttgaaaaaataggtttttgancccttatattttttttataagcggggtttt

SEQ ID NO: 51018 - DNA, 101 bp, rice(Oryza sativa)
  misc_feature (71): n=a or c
atgatcttgataggaagattttcgctacggccacaatggtctcaatcggtaatggtaggaaagcagatttntgggaatcaaattgggtgggacaccagcca

SEQ ID NO: 51019 - DNA, 101 bp, rice(Oryza sativa)
  misc_feature (71): n=a or g
gggcaccgtagtgtattcatctcccagtctatgttgcacatggcgttaattccaagtttagctatctcctntgactcgtagggcatccattccacctatgt

SEQ ID NO: 51020 - DNA, 101 bp, rice(Oryza sativa)
  misc_feature (71): n=a or c
gaggccactctcccactgaggtatcaattactgagttcaagtcacctttctccattgcatcctccacgatnttctttataccaacaggaggctttcctgtt

SEQ ID NO: 51021 - DNA, 101 bp, rice(Oryza sativa)
  misc_feature (71): n=t or c
gtgcatgggagaatttgacatatatcttgaatatatctactcctcagtccgaagataacttcatttctaanatgaacagtttattctaaaataagttcatt

SEQ ID NO: 51022 - DNA, 101 bp, rice(Oryza sativa)
  misc_feature (71): n=t or c
gtccgaggatgcgtctcaccatacatgccaacgaatgtgctgcacaggatttcggagagggacataaacanctgagttgacgtcgaacgcccttctccttt

SEQ ID NO: 51023 - DNA, 101 bp, rice(Oryza sativa)
  misc_feature (71): n=a or c
gctgcacccatgaacgcgaaaactgatctgtgattatttgcagctcgttgcgtgttacagtgcaacatggncccagcgccaggtccagatgcacctggcac

SEQ ID NO: 51024 - DNA, 101 bp, rice(Oryza sativa)
  misc_feature (71): n=a or c
ctgaacttctgaagcctggttaattttcagaatcaacgagccgaaaaaacaagcaaacaaaatcaccaacnaaatcaacatggcggattagcagatggacg

SEQ ID NO: 51025 - DNA, 101 bp, rice(Oryza sativa)
  misc_feature (71): n=t or c
gatgccacgaacacatctatgaaaacttgatgctggcagagactttgtaaataaatctgcgagattttcgnatgacttagtttgcaggacatttatttccc

SEQ ID NO: 51026 - DNA, 101 bp, rice(Oryza sativa)
  misc_feature (71): n=t or g
ctaaaatctctttccgttgccctatcgagcaattccgtcaatttcatcatgtcaggcgtcctgcggcggtngatcgaaagttcactatttagtttattggt

SEQ ID NO: 51027 - DNA, 101 bp, rice(Oryza sativa)
  misc_feature (71): n=t or c
actatcactcccccacttcccatctgttcatctgcagcaaatcccccatccgatttcagcttaatccatcntgattccggcaacctccagtgcattgtcgg

SEQ ID NO: 51028 - DNA, 101 bp, rice(Oryza sativa)
  misc_feature (71): n=a or g
tttcttgtcaatactgttgagaagccgaacaaaatcattcttcaaaaactcaggaaggttatcgttgcctntcaaaattcttgcgatattctgaatagttg

SEQ ID NO: 51029 - DNA, 101 bp, rice(Oryza sativa)
  misc_feature (71): n=a or g
gagttatgctctgttacttgaaaacggtagcttgtttaaactagctagaaaatgtcagcttttatatgacntagggtagttcttatgtaattacagaaatg

SEQ ID NO: 51030 - DNA, 101 bp, rice(Oryza sativa)
  misc_feature (71): n=a or g
gcatgatgagtattaatactactggtgtttgatggtacaagcagcgtcttgttcctgtaggcgtacgagcnggcgaagcagaggaacatcgcgagtgcgac

SEQ ID NO: 51031 - DNA, 101 bp, rice(Oryza sativa)
  misc_feature (71): n=a or c
ttgagtataaaatttcagcgatttcgggtttggtttaaaacgcaccaccaggacgtgtcaaaataactgtnaaggtaagcatgtggctgtgtaccacacgg

SEQ ID NO: 51032 - DNA, 101 bp, rice(Oryza sativa)
  misc_feature (71): n=t or c
gcagcaggagcagacacaacatcagcaggactcccacagcaggtatgacattgaaagcccagtcaatcatngacatttttctcatcataacatacaccata

SEQ ID NO: 51033 - DNA, 101 bp, rice(Oryza sativa)
  misc_feature (71): n=a or g
cacatcgccaccccgcccccttcatctgcaacaccttgtggccacgtgccccttcctccaagtgaccaatntgacctaggtgactcacagaaggtgggtcg

SEQ ID NO: 51034 - DNA, 101 bp, rice(Oryza sativa)
  misc_feature (71): n=a or g
gtggcagtcgacggcggtggtggatctaggtctttgtaggggaaaaaaaaagagaggatagtttccgtccnccctggaggaaaagatcacatatacctttt

SEQ ID NO: 51035 - DNA, 101 bp, rice(Oryza sativa)
  misc_feature (71): n=a or g
tacaagatgaagcccataagcgcagtgaaggtgaagcagctctccttgcaatgacgaatcttaactctgantctcaggaggaagtgaataggttgaccctg

SEQ ID NO: 51036 - DNA, 101 bp, rice(Oryza sativa)
  misc_feature (71): n=t or c
catgtgtcaaagccttgtgaatattgggcccaaaatcgtcccttgggtgggctgaaaactgaacatgtatncaacatgggcttgaatgctgacaggcagac

SEQ ID NO: 51037 - DNA, 101 bp, rice(Oryza sativa)
  misc_feature (71): n=a or c
tgccaacttttggatggagggagtatatgagagaatgacctctcccaagaccatcatgacgtgtcaaagtngaagaagaagaagaagaagaagaagaagaa

SEQ ID NO: 51038 - DNA, 101 bp, rice(Oryza sativa)
  misc_feature (71): n=t or c
tggacctcagccattggtgtcaaacgctcaacaacctccgcttcaattccaagcaaacccctcaattgggnctccctttggtagaccccctggaattgtaa

SEQ ID NO: 51039 - DNA, 101 bp, rice(Oryza sativa)
  misc_feature (71): n=a or g
aagctcagtagaggctttcatactagcaggttcgaaaatggagttttctgttcatcatctccgtctgtgcnttcctttccactgaatgaattttatatcac

SEQ ID NO: 51040 - DNA, 101 bp, rice(Oryza sativa)
  misc_feature (71): n=t or c
agcgatggcacagaatatttcaaggacattcagaacattagagcaaggtcaataatacaaggagtgtaccnatgtaacattcgaaagttttttttaggact

SEQ ID NO: 51041 - DNA, 101 bp, rice(Oryza sativa)
  misc_feature (71): n=a or c
tgctgcaaagccaaggccaggtgtgcgtttcgtacttattgtttctgcctgccgtggttgacactgacttnacacattaaactcttattactctcacgtgt

SEQ ID NO: 51042 - DNA, 101 bp, rice(Oryza sativa)
  misc_feature (71): n=t or g
ggcaggggagatgcatccaaggcctgaaagacaatcgatgtgaagtgaggcaaaatccttctggctgcacnatctgacgacatgataacttaccgaggggg

SEQ ID NO: 51043 - DNA, 101 bp, rice(Oryza sativa)
  misc_feature (71): n=t or c
gctcatgatgtaggtgtgctatctcaaccaattcctcagcaagattcaaagttcccaataatccaatatgnagatgacactctgatcattatgaaagcttg

SEQ ID NO: 51044 - DNA, 101 bp, rice(Oryza sativa)
  misc_feature (71): n=t or c
ttaggaaaagcgatgcacaccgtaaaaaccactggctaatacaatgcacgggaggaagatggaaagttggngacggcgacctaactctcgtcaggaacgct

SEQ ID NO: 51045 - DNA, 101 bp, rice(Oryza sativa)
  misc_feature (71): n=a or g
cgccgcaacataaaaaaagcgagcaaacccgttgctgcgcgctctgcgcttctgcccttttacgaccgaanaggtagccaacccacgcatcccccccctga

SEQ ID NO: 51046 - DNA, 101 bp, rice(Oryza sativa)
  misc_feature (71): n=t or c
gcattgcgggcattgaatcagagggagcgcaggcttccccatccgccaagacgacaccgatgcagtatatnccccatccatggcggcaacgaaaggaccta

SEQ ID NO: 51047 - DNA, 101 bp, rice(Oryza sativa)
  misc_feature (71): n=a or g
ctttcgagagaagaggacactgtaacaaaggccaatatagaggtaactttctgattgttatatacatggtnatcctggcggcggctatcctacccacgacg

SEQ ID NO: 51048 - DNA, 101 bp, rice(Oryza sativa)
  misc_feature (71): n=t or c
cttctgctacaaatcacctctccacattacaaggaacagcatctatacgatcataatgcatggatgggacnaatcactagctagacatgaaattaacgcaa

SEQ ID NO: 51049 - DNA, 101 bp, rice(Oryza sativa)
  misc_feature (71): n=t or c
ttttccacagaaacagcggcttgttggagctaaaaaattccacgaaacgtggaaactcgcctctgttttcntggcgtacttagacacagcatgtattcttc

SEQ ID NO: 51050 - DNA, 101 bp, rice(Oryza sativa)
  misc_feature (71): n=t or g
aacgcctccattgctcatcttttccagctgttgttgatgatgattctagcgtttcaatctgttgtggtgcntgcatgcacaagccaccacaacagagaaag

SEQ ID NO: 51051 - DNA, 101 bp, rice(Oryza sativa)
  misc_feature (71): n=a or g
aatacaacaaaagtttactggctagcagttcattgctgacatacgtaaaatctacactgctttggaaattncttttgcattattctctatgttttgaagtc

SEQ ID NO: 51052 - DNA, 101 bp, rice(Oryza sativa)
  misc_feature (71): n=t or g
cgccgtcgtcgacccggcccacccgtatctcctcgacctccgcgacatccgcgtggtgaagaagctcggcngcacggtcgacgacaccgagctcatccgcg

SEQ ID NO: 51053 - DNA, 101 bp, rice(Oryza sativa)
  misc_feature (71): n=t or c
ctagttattgtacatgcatcctatgaccacttagattattgcaacaagtacttgtcaggcccagcttgcgnctgtaatgtccggaatctcgataaatttat

SEQ ID NO: 51054 - DNA, 101 bp, rice(Oryza sativa)
  misc_feature (71): n=t or c
atgtcgtaatcagctttcagccttttcaggcagcagcaatctagctatagctacacccaaaagggatgtgncaaagaaaacgtgcgcatatataatttctc

SEQ ID NO: 51055 - DNA, 101 bp, rice(Oryza sativa)
  misc_feature (71): n=a or c
tcatgtacaccaccggagcctacaacgttctccaatttcttgtcacggtttattttgatcatatcatgcgntgggaatgatcttgatccatggatcatcag

SEQ ID NO: 51056 - DNA, 101 bp, rice(Oryza sativa)
  misc_feature (71): n=t or c
tctgaggtttcgtaccgtttgccagatctcaactggctctccttctatttggtgggggtacatttcgtgantttgagtatgatagtccctcttgccctgtt

SEQ ID NO: 51057 - DNA, 101 bp, rice(Oryza sativa)
  misc_feature (71): n=t or c
gcctaaaacgtgcacgagctatatctcagccagagcgagatttcagatgaaacccatcacattaggcaacnttttaactgatatcaatgagcgaggagacg

SEQ ID NO: 51058 - DNA, 101 bp, rice(Oryza sativa)
  misc_feature (71): n=a or c
gcgatggtttgaggaagcttggagatatctacaactccattgaggagctgatttgcacacctagtaaccangttagcctttgccagaagctgcaaaggaag

SEQ ID NO: 51059 - DNA, 101 bp, rice(Oryza sativa)
  misc_feature (71): n=a or g
agagggtgcagccacattaagcgtcgaatgaagcgcaggaatgtgtagcgaaagtgcagtcttaccattcntcccctcagggagaaccaatttcggcagac

SEQ ID NO: 51060 - DNA, 101 bp, rice(Oryza sativa)
  misc_feature (71): n=t or c
cttgaacacctaaattgacaggggatgctgaactccaaatggcagtcaactgctaaccgtccgatcgacangcgtcgcgcatccaacgacaggcgtggccc

SEQ ID NO: 51061 - DNA, 101 bp, rice(Oryza sativa)
  misc_feature (71): n=t or c
tcaacttgggctatttcgtcccaattaccaatgggctaattttggatcacgagatttgggcccacttcaanggtttatccacaccagtggcgatcgaccga

SEQ ID NO: 51062 - DNA, 101 bp, rice(Oryza sativa)
  misc_feature (71): n=a or g
tgctgcagtctctgttgcagctgcaggagttatccttggttggcctttctcaattttggtgtttctccctnttacggtttactcactaattagaggatctt

SEQ ID NO: 51063 - DNA, 101 bp, rice(Oryza sativa)
  misc_feature (71): n=a or c
atccctgccatcaaaatccgcagaattttcagctcaagatttccacggttgcaacgcgagaaagagaattnttgttaccgtcgaggtagaccgcgccgttg

SEQ ID NO: 51064 - DNA, 101 bp, rice(Oryza sativa)
  misc_feature (71): n=a or g
ttctaatgacgattaaaaggagggacaacaggtaggtcgtgaagcaaatggactagacggttaccaggacntctagaaagtaaaaaaaataaacaacattg

SEQ ID NO: 51065 - DNA, 101 bp, rice(Oryza sativa)
  misc_feature (71): n=a or c
ccacgagcgcagaagggaaggacattgcacaccatgctcatcgtggaagtgctctgagtatgagaagaagnagcctcttggaagagggtggcgaggcggtg

SEQ ID NO: 51066 - DNA, 101 bp, rice(Oryza sativa)
  misc_feature (71): n=t or c
gcagataatagtggcaccgatgctgagagcctggaccacggcgtggtcgacgttctccttgggcaagaggnggcgagagggggaatcgtgctaggatatca

SEQ ID NO: 51067 - DNA, 101 bp, rice(Oryza sativa)
  misc_feature (71): n=t or c
ccgtgcaaccttgtcgttccgatagggagagcgggaaaaacaaaggaggttgcgtctggattggctatatnggggagacagttccataatagctcaattct

SEQ ID NO: 51068 - DNA, 101 bp, rice(Oryza sativa)
  misc_feature (71): n=a or g
agctctgaacctttttagcttgccattttaactgacatggtaggacaacgttttggcactttcaacagtgncgtatggtaatggcagtgaagggagaaaat

SEQ ID NO: 51069 - DNA, 101 bp, rice(Oryza sativa)
  misc_feature (71): n=a or g
aggtaatcattgatcacacattcacttcttgaaaggtcgaaagatattggtgctaccgcaccgaccaatcnttctcagaacctcggtctttgccatcgagt

SEQ ID NO: 51070 - DNA, 101 bp, rice(Oryza sativa)
  misc_feature (71): n=t or c
ttattgccttcttcagcagaatatgcctccctagattgttgaagactatcattccccctctgctcactcgnctgttcttgttccacaatattaaaactgtt

SEQ ID NO: 51071 - DNA, 101 bp, rice(Oryza sativa)
  misc_feature (71): n=t or c
taatgtaattaatttggaaatacgcatctagatctcggtatttgttatagtgcgtcaatctagcccaaaancgtcacaacacatccgggatcctatgtgac

SEQ ID NO: 51072 - DNA, 101 bp, rice(Oryza sativa)
  misc_feature (71): n=t or g
aaaactggagggagtatagggagtatgttctaactccgtattaacatgattttcataaaagagatgagcanataatcactagttaaatatatcgtagaaaa

SEQ ID NO: 51073 - DNA, 101 bp, rice(Oryza sativa)
  misc_feature (71): n=a or g
tagattctgtaccatttgtttgagagcattttcatctgaaaggtgtctagaccactcaatgcatcatcctnttgctgagcaaccgaacgtttatgtccttc

SEQ ID NO: 51074 - DNA, 101 bp, rice(Oryza sativa)
  misc_feature (71): n=t or c
cattaaccctgaggtaatcgcaggtgtaataaccgtagaggatactgcctcgaggtcgcttgtgacacttnatggcatacacataggatgaattcgttaaa

SEQ ID NO: 51075 - DNA, 101 bp, rice(Oryza sativa)
  misc_feature (71): n=t or c
gctagggctcctacagctgctgcagtcatcgccacgggagccggcagggacagagaatggtgaagatgtgnggttcggcttggcagtgcggttggggatgg

SEQ ID NO: 51076 - DNA, 101 bp, rice(Oryza sativa)
  misc_feature (71): n=a or g
ttcctccgtttttccattcctatgattcaaagggacaaaggccagaactgctctagtgatacttaggggtncaagcgggccgacccgcgagtttaaataaa

SEQ ID NO: 51077 - DNA, 101 bp, rice(Oryza sativa)
  misc_feature (71): n=a or g
gacaggcttcaacgggacgcggctttgttaaagacggtggtcactgacttctacaacacaagatttggatngaatccatatgtgatgcggatacaggggat

SEQ ID NO: 51078 - DNA, 101 bp, rice(Oryza sativa)
  misc_feature (71): n=a or g
ggacagtcaaccaaacaacatcttatactagcctggttaaaccaatgcaaactaggggtgaaaacgatacngaaacttttcggattccgggcctgttttcg

SEQ ID NO: 51079 - DNA, 101 bp, rice(Oryza sativa)
  misc_feature (71): n=a or c
ggttcaaagctttgaaaatctctgcaaatctcctcacggatgacatcgagctaaggtcaagattaagaatntccatctttgcagacggaacttgtttcaat

SEQ ID NO: 51080 - DNA, 101 bp, rice(Oryza sativa)
  misc_feature (71): n=t or c
ttttattttattttttaggtgtgagcaagcagatggattggagggacatcatctcccttgctagaggttanactctgaactatcgctcctattaatccctt

SEQ ID NO: 51081 - DNA, 101 bp, rice(Oryza sativa)
  misc_feature (71): n=a or g
ttttaacaacatggtttaccctgccaattgtcccaatgtcccattgaccctcctctgatcaccaaaatganccaacaacaattcaacaacacacggggaga

SEQ ID NO: 51082 - DNA, 101 bp, rice(Oryza sativa)
  misc_feature (71): n=a or c
aactgcaagcatcctgtgagaccatttgtgtcgactgtcgacacgtacctacccaacgaccaacacactgntgcgtctgcgtggctgctttatctgcataa

SEQ ID NO: 51083 - DNA, 101 bp, rice(Oryza sativa)
  misc_feature (71): n=a or c
ccccccacaccgtatgccctatatacaaaataagctactacataccacccaaggaaggagatcaagaagcnaagaagccaagtagagctagctagctagca

SEQ ID NO: 51084 - DNA, 101 bp, rice(Oryza sativa)
  misc_feature (71): n=a or g
aatccggccggtgcatgacttgactatatcgatcctttgttacccaggttctgcatttggtgaatccactnttgggtggatatttttctcagtattacaat

SEQ ID NO: 51085 - DNA, 101 bp, rice(Oryza sativa)
  misc_feature (71): n=a or g
taggctgctccacaactccgctccaaaccccaactcctagagttaatagaagttaaaagctctacgaaacnggccctttgtgtgttgtctttggtgtttgt

SEQ ID NO: 51086 - DNA, 101 bp, rice(Oryza sativa)
  misc_feature (71): n=a or g
ggatgttatagaacccatgtgacctcaagctctacaggtcctaccgttgatggacatcatcggccctcttntcgatcaccaggcttccgcctcccttaagg

SEQ ID NO: 51087 - DNA, 101 bp, rice(Oryza sativa)
  misc_feature (71): n=t or c
acgtatgatgagacacactaggtgcaacttgcttgttggaaacgacgaataatattgactccacggagtancactaaatatgctttcagttattcttttag

SEQ ID NO: 51088 - DNA, 101 bp, rice(Oryza sativa)
  misc_feature (71): n=a or g
cctgatagatggttgtttctcacattgagtgtcttgagattactgctgttcgacagcaatggagatagccntcccgaagatcggttgttctcaaggctgag

SEQ ID NO: 51089 - DNA, 101 bp, rice(Oryza sativa)
  misc_feature (71): n=a or g
ctagtaggagctaattaagctgtgaacacacttaatcgtcacaaattaattagtgtgcatgcacaaccaanctagtacacataagcgctgattcgcgcgta

SEQ ID NO: 51090 - DNA, 101 bp, rice(Oryza sativa)
  misc_feature (71): n=t or c
tcttgctgcttcaccggcgttgacctcacaacggcagcaactgagggctagggaagcgcccactgcgcganggccgagcaccagcaacagggggcggcgcc

SEQ ID NO: 51091 - DNA, 101 bp, rice(Oryza sativa)
  misc_feature (71): n=a or g
aaacatgagtaatgtgggtatgccaaatcctattggccagctgacattgttctggatgtagatgatgacantcatagataacacaagggcagcagtacttg

SEQ ID NO: 51092 - DNA, 101 bp, rice(Oryza sativa)
  misc_feature (71): n=a or g
taataaccagttctggtatttggcagatccctatacatacatgtctgttcttcccttggactgcacagttntttctaaaggcatcccaatgccctatagtt

SEQ ID NO: 51093 - DNA, 101 bp, rice(Oryza sativa)
  misc_feature (71): n=a or g
aaacggcgggagctcggcggagacaaggcaagtgggtggctcctcaccacttcatttgcacccaatcgccnccatttcaccttcgcctccacacccatccg

SEQ ID NO: 51094 - DNA, 101 bp, rice(Oryza sativa)
  misc_feature (71): n=a or g
ctcaaggaccatccaatcaattttgtcctaataaaatttacaaaatactaagctgttggttgatgaagatnaacattgtaagatgcaagacgctaccaaga

SEQ ID NO: 51095 - DNA, 101 bp, rice(Oryza sativa)
  misc_feature (71): n=a or g
caccgccttcccgccggagtggatgcacatgtgctcgaacgcgcgttggaaatctggcacaatcgccgccncggcctttgggttcccggcgacatatgcgc

SEQ ID NO: 51096 - DNA, 101 bp, rice(Oryza sativa)
  misc_feature (71): n=t or c
gcatgcattaaatctattagcatgttctaaatattttctctaaaattatttattcgatcaacgatccgatnactgctatatttggtgcaattaaatcttta

SEQ ID NO: 51097 - DNA, 101 bp, rice(Oryza sativa)
  misc_feature (71): n=t or c
catgacagaggagatgggcatcactgtgggtaggaagaatgctctttatctgcatcctatagtccgtgtgnccttggaacaagctactatgtcgtagttgt

SEQ ID NO: 51098 - DNA, 101 bp, rice(Oryza sativa)
  misc_feature (71): n=a or g
aggattgcggcccgcgtcgtttgacttgggctgggtctctttggaagcgccattgttttcttcttcccacntcctcaaccctggcggccgccattgccgcc

SEQ ID NO: 51099 - DNA, 101 bp, rice(Oryza sativa)
  misc_feature (71): n=a or c
aacggctggtgttatacctgcatgaactgcatattggctggcctttattggtttcttgcaagtattacagnagaccttaaatataagatgtcaacacaact

SEQ ID NO: 51100 - DNA, 101 bp, rice(Oryza sativa)
  misc_feature (71): n=t or c
ttgtcttcatcgtcttcaatgtcgatgtcatcgtctgcttctggtaggctattcacaatctcgtctatacnttgcaattgctccggcatacttgacattat

SEQ ID NO: 51101 - DNA, 101 bp, rice(Oryza sativa)
  misc_feature (71): n=t or c
ctacgattaaggacaaacacatactataaaggagaaacaacagcaagctaaagatttgtactccctccatnccaaaataagtgcacttttgcactattcat

SEQ ID NO: 51102 - DNA, 101 bp, rice(Oryza sativa)
  misc_feature (71): n=a or g
aacctaacaagtaaagcttaacattcaaatatatgtggtacataccacacaatcaaccactaaaccactancaagtattagctcctaaagattaacaacaa

SEQ ID NO: 51103 - DNA, 101 bp, rice(Oryza sativa)
  misc_feature (71): n=a or c
accatcaaaatgtacaaaaacaaaattgaaggagcatagtctaaatcacctgttccactaagtgctcgtcntactgaaaacatgtaaatacaacatgtcag

SEQ ID NO: 51104 - DNA, 101 bp, rice(Oryza sativa)
  misc_feature (71): n=t or c
ttgcacaccaacatggataaaactgaaatcttcccaattagttgcaacaacctagaccttgatgcttgccnctctatcttccctggaaggatctcaacctt

SEQ ID NO: 51105 - DNA, 101 bp, rice(Oryza sativa)
  misc_feature (71): n=t or c
gctcattgggccagggtggttactggactttccttggtacagttggatgatttcatggacatgagcgacgntaatggttcctggaggtagttgtctgtgtc

SEQ ID NO: 51106 - DNA, 101 bp, rice(Oryza sativa)
  misc_feature (71): n=t or c
gaaaatgttacttcggtaaggcttggacagtgccaaacattctggattgaacgagtttcagagtcttcatnaccaaagaatgcaaacaagaagtctgccaa

SEQ ID NO: 51107 - DNA, 101 bp, rice(Oryza sativa)
  misc_feature (71): n=t or c
attttattttccatgggagatgtagccactttttccttctaagaagaatgtttaagggcctgtttagatcnatttggaatggtaaatggcaaatggtaaaa

SEQ ID NO: 51108 - DNA, 101 bp, rice(Oryza sativa)
  misc_feature (71): n=a or g
tctcatatataactatatgtatatatgagatggtaacacatatgtatgtttggtagatcatttggtggccngcttgaaggagctgagttggtaggtggtcg

SEQ ID NO: 51109 - DNA, 101 bp, rice(Oryza sativa)
  misc_feature (71): n=a or g
gagcaacatggggtggcaccctgtaaagatggaataacatgttgtgttgcaactttcatttggacaaactnggtatccaacaattttatttattgacaaaa

SEQ ID NO: 51110 - DNA, 101 bp, rice(Oryza sativa)
  misc_feature (71): n=t or g
tgtgtgttcctctctctgtcggccaagtcaaactaatagtggaacaccagtttttgtgctgctgtctgcanctcatatataacaactcatttttttaccgc

SEQ ID NO: 51111 - DNA, 101 bp, rice(Oryza sativa)
  misc_feature (71): n=a or g
aacactactcctcaaaatcaagcaacgtgtatgaattcctccttttccactaaatccatgtactctctccntctcattttaaatatagatgtaaattttca

SEQ ID NO: 51112 - DNA, 101 bp, rice(Oryza sativa)
  misc_feature (71): n=t or c
attcatatcatacaatggttcagttctcccaacagttgtgctttgtaattagctacttttctgcagtgatngtatatcccgtttgcatgaaatactattcc

SEQ ID NO: 51113 - DNA, 101 bp, rice(Oryza sativa)
  misc_feature (71): n=t or c
cttgagttttcctgagtgttcggtttatgggagaatgcacgtttaaatatgcatgggggaggccccatggnagaattccatagttccccaaataaatttgt

SEQ ID NO: 51114 - DNA, 101 bp, rice(Oryza sativa)
  misc_feature (71): n=a or g
ggggcagaagcccttgggcgatggagaaatggtgacatgtcagccacccaggatgaaattcatgaactatntatactcatgttgtgattttactttagcgg

SEQ ID NO: 51115 - DNA, 101 bp, rice(Oryza sativa)
  misc_feature (71): n=t or c
ggttttgaggccatggcctcagatgccacttcaacagttgagctatctcacgtttacctagaattgcatgnatattgtagcacctattgcagtttaaattg

SEQ ID NO: 51116 - DNA, 101 bp, rice(Oryza sativa)
  misc_feature (71): n=t or c
tttcttgtacgagaaggttttctaggtggattaggacttttttataagtttgattcatggttttaggttgnatacatcatgtataaatagagagggagggt

SEQ ID NO: 51117 - DNA, 101 bp, rice(Oryza sativa)
  misc_feature (71): n=a or g
ctaagatcaaatcatagtgtaccacgccaatttttatgaagagtctgaccagtctaattttttttaaaagnggctgttcagattgtaatcaaaataaacct

SEQ ID NO: 51118 - DNA, 101 bp, rice(Oryza sativa)
  misc_feature (71): n=a or c
ttgcttggagatctgaaatactaaaaggaaacagggtgaggcatgcaaaattcagacaaaatgaccgattncacatcaaagcttcaacaccatgttgagct

SEQ ID NO: 51119 - DNA, 101 bp, rice(Oryza sativa)
  misc_feature (71): n=a or g
gcagctgctgcgtcgatctgcgtttctctctgcgtttcttcagaaaggctctcaacttgatgaagatgaantgacaagtgtgtgtgtctgtgcctgcgtga

SEQ ID NO: 51120 - DNA, 101 bp, rice(Oryza sativa)
  misc_feature (71): n=a or g
ggtcagccgcttgccagactccttgggtggcctgaggcagctgcagaccctggatatcaggcacacctctnttgtcagattgccaacagtcatcgtcaagc

SEQ ID NO: 51121 - DNA, 101 bp, rice(Oryza sativa)
  misc_feature (71): n=a or g
aggaaaggactggtgcggtgcagtggctttcttttacattttggaaaattcagatgtagagaacgggatgncatgatgcgtaagcgttttgtccggccttc

SEQ ID NO: 51122 - DNA, 101 bp, rice(Oryza sativa)
  misc_feature (71): n=a or g
gtacttctcgtacgctctttggtggctgcatttgcagtatagcatcaatcttttctgggttggcatctatncctctttcggacataagaaatcccaacaac

SEQ ID NO: 51123 - DNA, 101 bp, rice(Oryza sativa)
  misc_feature (71): n=a or g
gcagagagcacaagtcagaccattggctaaatgattctacggagcaggttagatgcagcaaggcaaaaatntgatataagttctaaggtccacaaaatgct

SEQ ID NO: 51124 - DNA, 101 bp, rice(Oryza sativa)
  misc_feature (71): n=t or c
ctccatgtactcatagacaagcagatgctctttctccttttccttccggaacggtggcaggaggcgccgcngcttctcctcgaccaacacatcacagtagc

SEQ ID NO: 51125 - DNA, 101 bp, rice(Oryza sativa)
  misc_feature (71): n=t or g
ctttgaggaaagttgaaaacatgttttaaaaaaaatttctaaggaacattaatggggaataacatgctagnttggtttgaaactaaattttgtccttataa

SEQ ID NO: 51126 - DNA, 101 bp, rice(Oryza sativa)
  misc_feature (71): n=t or c
gccgatctccggactgccaataaggtttctctcgacaaggcgttccccaaggatgaggacggcgacgcgcngcccctcaaggatgaccgccgcctccgccg

SEQ ID NO: 51127 - DNA, 101 bp, rice(Oryza sativa)
  misc_feature (71): n=t or c
ggcagctgggagtatggagagcagattcatggcttatccatcaagtataggttggaccgtgatttatatgnaggatgctcactgagcgacatgtatgcgcg

SEQ ID NO: 51128 - DNA, 101 bp, rice(Oryza sativa)
  misc_feature (71): n=a or g
tggtacaatatcacatacatgtggcagtccagtcagcaaaataatatgatcaaggtgggctctgatatacnaggttgcttgggcgaggcgggcatcatccg

SEQ ID NO: 51129 - DNA, 101 bp, rice(Oryza sativa)
  misc_feature (71): n=t or c
acataggagtagcagtagtagatgggagagacagacagacaggcggggagatgggcgggcttgaggttggnggtgttgcgggcgaggaggcggcagaagga

SEQ ID NO: 51130 - DNA, 101 bp, rice(Oryza sativa)
  misc_feature (71): n=t or c
acgaagtcagcaaagacaaagatcaacgagaaggatggtgaggaattcttggtgttaaggaggacaaaggngacggacggcgatgaatacttggtcgtaaa

SEQ ID NO: 51131 - DNA, 101 bp, rice(Oryza sativa)
  misc_feature (71): n=t or c
ctaatatgtgtacagatatgggccagctaacacgatgtaaagtttgatgactaaggccttgtttaattcgngaaaagaaaatttttgggtgtcacatcgga

SEQ ID NO: 51132 - DNA, 101 bp, rice(Oryza sativa)
  misc_feature (71): n=a or g
aaatcgccgtggtagcctaaaaaaaaattaaaaatcggagaaaaaggggatatggttatggttgttcctgncgcacgacgcgggcaacgagctaatctcgg

SEQ ID NO: 51133 - DNA, 101 bp, rice(Oryza sativa)
  misc_feature (71): n=a or g
tctcatcatgaaggaaggctctcatgtattggcccagatcaagttgcctatgcccaagcccatttccttcnctactggagaagcgattttcagtccggttt

SEQ ID NO: 51134 - DNA, 101 bp, rice(Oryza sativa)
  misc_feature (71): n=a or g
ctcttcgtcttcgagcgcaacagctccctcaacctctacctctccattgttctcccaccgcgaggcgctcnaggcggcatcgttgccagtgccacctctct

SEQ ID NO: 51135 - DNA, 101 bp, rice(Oryza sativa)
  misc_feature (71): n=t or c
catttgcctttaccttggaatctaactacaaagataaggccaatatgcagacatgtcgagtgcacatcatnagcaattcaaggtctaatatcatttacaga

SEQ ID NO: 51136 - DNA, 101 bp, rice(Oryza sativa)
  misc_feature (71): n=t or c
ctaacctgcatgaaaaccaggggcttgccaatgatgacactagtgtcaccagggtcacacaagaactcgtngacgcatggatatggtggcatgatgggatt

SEQ ID NO: 51137 - DNA, 101 bp, rice(Oryza sativa)
  misc_feature (71): n=a or c
cgttcaccttcggtacaggaagggaaacccgatttcgaatcagcaaactcacctcaaacagctcagctcgnaaatcaaaatccaattttgctctccaatcg

SEQ ID NO: 51138 - DNA, 101 bp, rice(Oryza sativa)
  misc_feature (71): n=a or g
tctactttcatagttgaaacagatccataacacattggaaagtgaaatctataatttcaccactgagtcanctcgtaggattggaagttatcaggaacatg

SEQ ID NO: 51139 - DNA, 101 bp, rice(Oryza sativa)
  misc_feature (71): n=a or g
cttccgcttcccctcctccatcacccagccacctccgatccgtcagacaaaataccgctccaaaacgatangtattatcaattcggagagaacgtaagtaa

SEQ ID NO: 51140 - DNA, 101 bp, rice(Oryza sativa)
  misc_feature (71): n=t or c
actgaaggaaaaatctactatctggcatactatagagtcaagccacgtaacaaaatctacaggccagttgnaaacaagtttgctatctccctcacaaaatg

SEQ ID NO: 51141 - DNA, 101 bp, rice(Oryza sativa)
  misc_feature (71): n=a or g
gaaaagggaatatttcctaaactaaaccaacctctgagtataataatattattgtaccagatatgcagtgncgtagctagaatttagagtaaaagtggtct

SEQ ID NO: 51142 - DNA, 101 bp, rice(Oryza sativa)
  misc_feature (71): n=t or c
aattatttgaatggaaagttcataattttgtgttgaaacttcatgcctaactaatatatattcctaccttngaattactctgttttacgttataggacgct

SEQ ID NO: 51143 - DNA, 101 bp, rice(Oryza sativa)
  misc_feature (71): n=a or g
cctcctcaactagcttaatttgcatgctgatctggttgagtaattaacagttacagtcgtcgtcgtcgtcntcatctcctctttggtttctcctgaacaat

SEQ ID NO: 51144 - DNA, 101 bp, rice(Oryza sativa)
  misc_feature (71): n=t or c
gaggtctcagatcaactctctaaagtagcaaaggaacacacgaagattgctgtgggtagcattgcaactgnactcaagtttaagcaagaagtcctaaagca

SEQ ID NO: 51145 - DNA, 101 bp, rice(Oryza sativa)
  misc_feature (71): n=t or c
cgggggctccaagaccgatggaaggtaagcggtggcatctccattgaacactgggagtatttgcgaagatnatatttgctctcatggcatccttctcgcgg

SEQ ID NO: 51146 - DNA, 101 bp, rice(Oryza sativa)
  misc_feature (71): n=t or c
catatctgaaattctgaatatcattgctgtttatttgcttgcttttggtacacattttcatgtgtgagtgncacacccgatggtatgacaggggacgtgcg

SEQ ID NO: 51147 - DNA, 101 bp, rice(Oryza sativa)
  misc_feature (71): n=a or g
aactcaccctcagtttttgaatgaatataggatcaaaccattttatcagtcagtcggtgctgtggacggcncactgacgatgggaaaaccgggacggtcgt

SEQ ID NO: 51148 - DNA, 101 bp, rice(Oryza sativa)
  misc_feature (71): n=a or g
tccttcggagtgccacctgcattgatctggaaccaccctttggatatgttccatcgctctctaaggattgnggttattcgtcagcataacacaacaccggc

SEQ ID NO: 51149 - DNA, 101 bp, rice(Oryza sativa)
  misc_feature (71): n=t or c
cctatccagcttggtaatctctcgaagctgcactaccttgataactcactgtgcgacaatctgtattccgntgatctctctgtttttcttttagagaagga

SEQ ID NO: 51150 - DNA, 101 bp, rice(Oryza sativa)
  misc_feature (71): n=a or g
taatattcaatatttaaaatttgatcaatgggataactaaaagaaaatctttcccctcaccttaatatttnctgaacaacctagaacgaattatatttaga

SEQ ID NO: 51151 - DNA, 101 bp, rice(Oryza sativa)
  misc_feature (71): n=t or c
ctccactgtgttttgaatattgacgtatgctgcataaaccggaagaatttgcaaagaatctccatgagaangcatttcatgtaccaaaagttccatgaact

SEQ ID NO: 51152 - DNA, 101 bp, rice(Oryza sativa)
  misc_feature (71): n=a or g
ggtcctaccatataatctcatatcctgtccatagtaaacactgaaccgaaaatgttcccctttcccacttngcgtccttgtgagtccctttaacaatatca

SEQ ID NO: 51153 - DNA, 101 bp, rice(Oryza sativa)
  misc_feature (71): n=t or c
ttcttttcacaggttagcactattcgaagaaagattctggtgtttcctacttcctggtgaggccatttccngacagacacaacgagaataatggcatagat

SEQ ID NO: 51154 - DNA, 101 bp, rice(Oryza sativa)
  misc_feature (71): n=a or g
aggaccatttgtttgattaacctaacttccatgttattttgactacagcgttggtcctctgagtctgaggngggcgcgccatgccttgacgttctttagtc

SEQ ID NO: 51155 - DNA, 101 bp, rice(Oryza sativa)
  misc_feature (71): n=t or c
caaagataggctttaaatgtcacaatactcatatttgtcaatggcatgcaaaattatactcccttcgtccnagaatataagaagttttagagttggacatg

SEQ ID NO: 51156 - DNA, 101 bp, rice(Oryza sativa)
  misc_feature (71): n=t or g
tctgcattcatttcaacatggtcagtgaatatgaatgacaagtccgttctcatggccaaggcttctaactnaatttattgttcctttgctcacatagccaa

SEQ ID NO: 51157 - DNA, 101 bp, rice(Oryza sativa)
  misc_feature (71): n=a or c
cctggaaatgggtcatttggttggaatcctagggatgatcggtcgaatagaagaacggcggattgagtatnatcaagctagactcaattccggtagcctgg

SEQ ID NO: 51158 - DNA, 101 bp, rice(Oryza sativa)
  misc_feature (71): n=a or g
acattttatcctcactcttgcggcgttgtgttttggttttcgtcgacgataatctgatctatagccgtatnttggaggaacatgttaatcatttgagggtt

SEQ ID NO: 51159 - DNA, 101 bp, rice(Oryza sativa)
  misc_feature (71): n=a or g
tcgaacttcctttgtttgtcatcagccaagcgcttggagtcttggacgttacatgtcttgaaattacatanacatatagtatgattatatctagttctctt

SEQ ID NO: 51160 - DNA, 101 bp, rice(Oryza sativa)
  misc_feature (71): n=a or c
aaaattcgtcgtacagaaaaaataaagcaaaggtacacagtcctgttatctggtccaggaaattgcactgnagaatttatgtcatggatctgtcacttatt

SEQ ID NO: 51161 - DNA, 101 bp, rice(Oryza sativa)
  misc_feature (71): n=a or g
tggctctcggaggacgaagcagaagcaaaacacttacagctccgagttgccaagtacaaactagtctccgngcaattatatcgcatcggcgtgctacaacc

SEQ ID NO: 51162 - DNA, 101 bp, rice(Oryza sativa)
  misc_feature (71): n=a or g
tacattccttagatgtaccaataagagctgatttttattacttcctccgtccaagattgttgcaacctaanattgtaataggatgggtctaatctcattat

SEQ ID NO: 51163 - DNA, 101 bp, rice(Oryza sativa)
  misc_feature (71): n=a or g
gtacagcccggttaggaatatcaattatgagtagcccatcactctcgatgtcaattatttttcccacgctntgatgggtttcaccaccccaggcatatcta

SEQ ID NO: 51164 - DNA, 101 bp, rice(Oryza sativa)
  misc_feature (71): n=t or g
gatttattggtaactgtaacaaataccaataataaccaactacaaaacccagacatgggtatcctaatatntttcactctaatatttcacctcaaaacaat

SEQ ID NO: 51165 - DNA, 101 bp, rice(Oryza sativa)
  misc_feature (71): n=a or g
gcgctcgtttgggccggtcggaagccttctactccagcacgaaaatcgaagcagcttgtcattagtatatnattaattaaggtttttgtcaaattttggtt

SEQ ID NO: 51166 - DNA, 101 bp, rice(Oryza sativa)
  misc_feature (71): n=a or g
ggtaaccagccttgctcctctatgcgtgtgacacatagtaaaaaaacaagaccggtggttgacccgttctnatcgtcggttcaccggtcgaaccgccgggt

SEQ ID NO: 51167 - DNA, 101 bp, rice(Oryza sativa)
  misc_feature (71): n=t or c
ggaggcttttaggattcttgggaacttgccttctctcattactctctggctgtggacaaaaacagtagtcnccaagagaagatttatcatacataatgttg

SEQ ID NO: 51168 - DNA, 101 bp, rice(Oryza sativa)
  misc_feature (71): n=a or g
aacagtgccgtgagcattgccccaggtgctgtcgagaacgagccagagtgggcaatcaaatgctcgcacangcaggcctacccctacgcatggcggggcgt

SEQ ID NO: 51169 - DNA, 101 bp, rice(Oryza sativa)
  misc_feature (71): n=t or c
gtaatgattgctgcggtctctgactcttcgacatcagttgtggccttgtattttgtggtgactgctgtggncttcggccctgcaatgactgcagcggccac

SEQ ID NO: 51170 - DNA, 101 bp, rice(Oryza sativa)
  misc_feature (71): n=t or c
atgcaagaaaatggaaccacagcagcaacactgtacatgtgcgaaaattggtactttttttggtggacacnagatcagtgccaaaaccagataattttatg

SEQ ID NO: 51171 - DNA, 101 bp, rice(Oryza sativa)
  misc_feature (71): n=t or c
gtgcccagcacgctgcaccggcaccgcaccacctatgaacaaaggaagaagatgacgacgaagggcgtaancatcaccaagatcatcttgtggttgtggaa

SEQ ID NO: 51172 - DNA, 101 bp, rice(Oryza sativa)
  misc_feature (71): n=a or g
actcaacaagattggataaactgcctcctaaaccgttcaaggagtcaatttgtaatggttttgtgagttgnaggataggttatagggatgcgattcaacca

SEQ ID NO: 51173 - DNA, 101 bp, rice(Oryza sativa)
  misc_feature (71): n=a or g
taagttttgagaaaaaaaaaagagatatatactaccttcgtttttagtagatgacactgtagacttttagncacacgtttgaccattcgttttattcaaaa

SEQ ID NO: 51174 - DNA, 101 bp, rice(Oryza sativa)
  misc_feature (71): n=a or c
tggcagatctaccgttggaggcttgtgcaagccccacctccaattgctactccctccatcctactccctcnattccatattataaggcacaactatttttt

SEQ ID NO: 51175 - DNA, 101 bp, rice(Oryza sativa)
  misc_feature (71): n=a or g
gttcatatacacgcgcacactcatctctgcctactactatctactcataaatttagatatagacgaatgcncgctacgaagacagggtcgccaatacgagg

SEQ ID NO: 51176 - DNA, 101 bp, rice(Oryza sativa)
  misc_feature (71): n=a or g
ctgacgtcccatcggcgaagccatcctagcggcagttatatccactcggggatacaaagattttgtcatcnccaaggcctggctagctcccctggtggcat

SEQ ID NO: 51177 - DNA, 101 bp, rice(Oryza sativa)
  misc_feature (71): n=t or c
ttaacaactcccaatttggtagcagcaattccctactagaattgggacctgatgctacacaagatgtagtnttctatcaaagaaacagtcctgagccgcaa

SEQ ID NO: 51178 - DNA, 101 bp, rice(Oryza sativa)
  misc_feature (71): n=t or c
ttgatttcctctctatttggtagtgcaacggttggtccatttgctctcgtcacccgggtctcacctgtggngtgcctccccatccgcgccgcctggaggag

SEQ ID NO: 51179 - DNA, 101 bp, rice(Oryza sativa)
  misc_feature (71): n=t or c
ctataataacttatattgtgaaacggaggaagtaaaaaaaaaaacttctggtatgagatactgtacgtcancatctcttctttgaagtggccaaatcttga

SEQ ID NO: 51180 - DNA, 101 bp, rice(Oryza sativa)
  misc_feature (71): n=a or g
gatgaagaaaaaaaattagatagcaacatgaagacgagtaagaaccagttcgatgtccctttgattgacanaggtcgcagtcgtcagttcgatcggcttcc

SEQ ID NO: 51181 - DNA, 101 bp, rice(Oryza sativa)
  misc_feature (71): n=a or g
tgtcctctcagacccgcgtgctcccaaagtcccgatcaatattggttcctatccagcactgatgaaatacntatcaatattggttcattaaaagacttggc

SEQ ID NO: 51182 - DNA, 101 bp, rice(Oryza sativa)
  misc_feature (71): n=t or c
catcagctgcaaggaggactcattgctaagcaagcctgcatgtgggtagtgtgtcctctgaaattctgaantgccggatggatctgcatggatgtgagcta

SEQ ID NO: 51183 - DNA, 101 bp, rice(Oryza sativa)
  misc_feature (71): n=a or g
gctaataatccattgaacagaaggaacactagttatgcacaggcaagacatgaagacatatagcattatanctaggaaaaggcagaggttagtttcacaat

SEQ ID NO: 51184 - DNA, 101 bp, rice(Oryza sativa)
  misc_feature (71): n=t or g
cacgatcttcccagaagcaagggatgcattaattttctccccatccttaattagacagctgcgaccataanatgcagacattttgaggaattagtgtagca

SEQ ID NO: 51185 - DNA, 101 bp, rice(Oryza sativa)
  misc_feature (71): n=a or c
aaaagttttgaccgaaacttgtcctaaacattgacaatttatgaccgaagagagcataaagcttggtagtnaatcctctgttcttgttcagccgtgttcgc

SEQ ID NO: 51186 - DNA, 101 bp, rice(Oryza sativa)
  misc_feature (71): n=t or c
cccaattttacctccatccattcacaaaagcttgacgctttcgcctttgttctacgtacaaatgcatgtgntaaatactgtaggaatggtcactttgccct

SEQ ID NO: 51187 - DNA, 101 bp, rice(Oryza sativa)
  misc_feature (71): n=a or c
ttttgccttttgatggcatgaagtgtgaggcatggaggagcttgaagaattctcgtcagagaagagggatnaggggtgagagaatatgtgcatattcgttt

SEQ ID NO: 51188 - DNA, 101 bp, rice(Oryza sativa)
  misc_feature (71): n=a or g
cttccacaattagccggccattaattggttgatcaaagaacaatggtaaggtgagcataggtaccccagcnaagacagcttccagcgtcgagttcattcca

SEQ ID NO: 51189 - DNA, 101 bp, rice(Oryza sativa)
  misc_feature (71): n=a or c
cagtaagttcactaaaattttacatgtttattttgaggtacaccagatatctttcgctccagtgccttggnattaaatgggaccgagaattcttcagctat

SEQ ID NO: 51190 - DNA, 101 bp, rice(Oryza sativa)
  misc_feature (71): n=a or c
atgcacataatatattctaccaatttttgcagcaggtgttcgctggcaccatactctagatgacgactccnatgaccactctttcggaaattcacagtatg

SEQ ID NO: 51191 - DNA, 101 bp, rice(Oryza sativa)
  misc_feature (71): n=a or g
gaatatatacttttgtcaccttcctgcttctcaccgtttgcaaaatttgaccatgcgttcatattacttcntacaatcgtacgtactctagtactagttgg

SEQ ID NO: 51192 - DNA, 101 bp, rice(Oryza sativa)
  misc_feature (71): n=a or g
ttcaaaacagtgtggacagtggataggctacacgtgataggttggccaaaccagcaaatatgccctttgtncggagcaatcgatgaatccaccatccatct

SEQ ID NO: 51193 - DNA, 101 bp, rice(Oryza sativa)
  misc_feature (71): n=a or g
tggatgacggcagcgtcttgtgtggaggggtaaaagaaaacgattgcatcatccgcatatagggacactcncagcggcagcaaatctctagcaagcgggga

SEQ ID NO: 51194 - DNA, 101 bp, rice(Oryza sativa)
  misc_feature (71): n=a or g
taggtatgtgaggcattaggcatattttatcctccaaaaagttgagctctggtcttcgtcagatattctcncgcaccttcatggtatcaagaacatattgg

SEQ ID NO: 51195 - DNA, 101 bp, rice(Oryza sativa)
  misc_feature (71): n=a or g
tacattgtgtttggactgcaggtgcaggaagtgagcctccgggcaaacttgattcagattcaggcaaagcngaaggttgacatgggagcatctgtcccggc

SEQ ID NO: 51196 - DNA, 101 bp, rice(Oryza sativa)
  misc_feature (71): n=t or c
attaattatatttatgcttgcacatcttttattcttcatttactcacattgtcataaaaagcgtcagacgntcatttcgttgtttccaaaatatttgcatc

SEQ ID NO: 51197 - DNA, 101 bp, rice(Oryza sativa)
  misc_feature (71): n=a or g
tcaacttcctcttcctccttcctcctcctgcatcatggcagtgcttgtcactgcctccagtgtcgggatgntgctccgatgtcggtcacacatcgttgccg

SEQ ID NO: 51198 - DNA, 101 bp, rice(Oryza sativa)
  misc_feature (71): n=a or c
atccctgaaaggcagatgaaaattagggcacatttttttagtcctaattgccaatcatatttcccagcacnttccatcgaattctgttgttcagcttgttc

SEQ ID NO: 51199 - DNA, 101 bp, rice(Oryza sativa)
  misc_feature (71): n=t or c
ctcatcgccttttctactactccatcttccacgatgtccttgacatcaacatggatccaacatatacattncgtgatctaagggtcactatcaagaacatc

SEQ ID NO: 51200 - DNA, 101 bp, rice(Oryza sativa)
  misc_feature (71): n=t or g
caacacgactacacaataggtaaacaggaaaaaagagagaaaataacaagagatgatcccttaaccaaaancatttttttaattatgctatgaaatacaaa

SEQ ID NO: 51201 - DNA, 101 bp, rice(Oryza sativa)
  misc_feature (71): n=t or g
gctgaaacataactaaatttccctcgatatctcgttctctgcaactccgcgcagcaaaaaaaatatttggntttgtgaactatgacaacttcttcgaaatc

SEQ ID NO: 51202 - DNA, 101 bp, rice(Oryza sativa)
  misc_feature (71): n=a or g
acaacaattaaagtcaacatgagaaagcatctcaatgtatgtcacctgaaccatgattggattcggtcctncagagtttatataaacagaagatccagcat

SEQ ID NO: 51203 - DNA, 101 bp, rice(Oryza sativa)
  misc_feature (71): n=a or c
tgactcatgttgaagaagaccagaaacaaccacaggcaatctccttgatggatgaacaagttttgaggcantctcagtaggaacatttttcagatggagcc

SEQ ID NO: 51204 - DNA, 101 bp, rice(Oryza sativa)
  misc_feature (71): n=t or c
attttttaaaggctgcttttttagtgggctgctcctttttctgttcgtttggttactgacaggtcgatttngtggtgcgagtggttgtaaagtctgatgtc

SEQ ID NO: 51205 - DNA, 101 bp, rice(Oryza sativa)
  misc_feature (71): n=t or c
ccaatgcccccgacctctgaaccagcatcatagaacatccatgtcctgcggcaaacccccaagaaagcatnaatgtcattggaggtccccaaaccagggcc

SEQ ID NO: 51206 - DNA, 101 bp, rice(Oryza sativa)
  misc_feature (71): n=t or c
cacaaaatttggactcaaatttatgcaataaaaaaaagagagaagggattcacacctcttcgagcagtcgngccacctcccgttggcgagcccgccgccgc

SEQ ID NO: 51207 - DNA, 101 bp, rice(Oryza sativa)
  misc_feature (71): n=t or c
gtctttgacatgctgcaattaattgaggaggaaagctcccattagcaattgcaatccccaccgagaaaatngacccaaattgcccagccaatcgatccatc

SEQ ID NO: 51208 - DNA, 101 bp, rice(Oryza sativa)
  misc_feature (71): n=t or c
ttctactacatcctttccaggacaggtcttgacatccgattcatcacttatcaatttcccagcagtgttgnccctggtagcaaagaacaacaatttataat

SEQ ID NO: 51209 - DNA, 101 bp, rice(Oryza sativa)
  misc_feature (71): n=t or g
ctgcatattttgtcatgctttggtttttcatctaatgttgcgggtctctgctggtggctctcatctcgggntacacagttattctgtgacctattttatct

SEQ ID NO: 51210 - DNA, 101 bp, rice(Oryza sativa)
  misc_feature (71): n=t or c
ttcatttgtccgtcatcgtacaccgggctcttcgtccgtcattcgcaatcccgtgagcttcgtctgtgcgnccgcgtcccaacgcccgcacgagcgttcgt

SEQ ID NO: 51211 - DNA, 101 bp, rice(Oryza sativa)
  misc_feature (71): n=a or c
cggcatcccatccgggcctggggcctttaaatccccgatagaatctaaggcctcttttatttcttcacttntgtatgcacttgttagtaactcattcatgt

SEQ ID NO: 51212 - DNA, 101 bp, rice(Oryza sativa)
  misc_feature (71): n=a or g
tgactgcacggtctccgaggctcaactgaacagcagaaaattgaaagaaaataccggtacgaagtaccctntctcgtaaaaaaaaaactccctccgtccca

SEQ ID NO: 51213 - DNA, 101 bp, rice(Oryza sativa)
  misc_feature (71): n=t or c
actgtgatgttggcgtgaaggcttttcaggtagaatgacttgatggatttttagctgcagactgatgagtngaaatcttggtatcatctcatattctgagc

SEQ ID NO: 51214 - DNA, 101 bp, rice(Oryza sativa)
  misc_feature (71): n=a or c
aagaaggccggcgatgctgtttctagtgacaaggggcctgatgatgagacaaagtctgcaccatctatcantcccgaggataataaaataggtgaagaatc

SEQ ID NO: 51215 - DNA, 101 bp, rice(Oryza sativa)
  misc_feature (71): n=t or c
ggtcctaactgtggttggcaccaatggctggctgagaaagagcaaagtaaattcgctcatggagtcagganaactaattaaaccaaaagtatttttgctat

SEQ ID NO: 51216 - DNA, 101 bp, rice(Oryza sativa)
  misc_feature (71): n=t or c
atgtggctagccgcaaaggatagggtggagtacgccggcgatggggttgtttgctaatttttcttttgctngttgtctctatgacatgatcaagaatgttg

SEQ ID NO: 51217 - DNA, 101 bp, rice(Oryza sativa)
  misc_feature (71): n=a or c
aactatactctcttcatcctgttttgatcattctctaggttattaagttattcccaaataatcatctaacnagtatacactggtggagaaaccatctttgg

SEQ ID NO: 51218 - DNA, 101 bp, rice(Oryza sativa)
  misc_feature (71): n=t or c
acatcctgctaaaattgtactacttcctccatcccaaattaggctgtgttggataccaaaagttcccactncccatctcgttttccacgcgcacgcttttt

SEQ ID NO: 51219 - DNA, 101 bp, rice(Oryza sativa)
  misc_feature (71): n=t or c
aagcaattgaagaaagtttgttggatcagagtggatttagaagaattgcttacctgttatgacttctggtnggggacgagcaggcccttccaccctaacag

SEQ ID NO: 51220 - DNA, 101 bp, rice(Oryza sativa)
  misc_feature (71): n=a or g
gaatcgatcatcatttgtattgtccacatatatacccatcgacagaatgggttagctgaacggaaacactntcacattgttgaagtgggtctttctctttt

SEQ ID NO: 51221 - DNA, 101 bp, rice(Oryza sativa)
  misc_feature (71): n=t or c
tcgatcatggcttctcctgcggtcataatccctgtccctatcacggctgctgcctcgatctcctctatggngatccttgctagatgctctgtcacgttcca

SEQ ID NO: 51222 - DNA, 101 bp, rice(Oryza sativa)
  misc_feature (71): n=t or g
cgtcatggcagcgtaatttacagaaagatgaggagtgcattccagtccagctgtccatcgtgaaacttaanaagcagttgggctctgttgcgctcgcatca

SEQ ID NO: 51223 - DNA, 101 bp, rice(Oryza sativa)
  misc_feature (71): n=t or g
tactcctttctaacgtatataacacctcacttacacatccactcactctatgtataaaagggtttacctancgtactagcactactggagaaaccatcttt

SEQ ID NO: 51224 - DNA, 101 bp, rice(Oryza sativa)
  misc_feature (71): n=a or c
gctttagacttggcttttattgatccttccgaaagcaacttaacaaggcaaggaaccaccccatgtccaantgctaaactttgtaattttttatcccaagg

SEQ ID NO: 51225 - DNA, 101 bp, rice(Oryza sativa)
  misc_feature (71): n=t or c
tgctgctgtttctgcaaaatttgatagggatcaacatgagaatttgattaggcaaatggatagcataaaanagaatggtacagtttgggagttttatgaac

SEQ ID NO: 51226 - DNA, 101 bp, rice(Oryza sativa)
  misc_feature (71): n=t or c
ttagctaaaaataagagagaaggggagagttggaggttggacagagggaaggggagggagtacgtacttgnggacgtatagtggaggtgaaggctaccgga

SEQ ID NO: 51227 - DNA, 101 bp, rice(Oryza sativa)
  misc_feature (71): n=a or c
actagaagagacatggcataaagcataattgatgttacctctttctcttctgtgaccggtgaatccaggcnatgacaggagggaggatcccaaaaaggaag

SEQ ID NO: 51228 - DNA, 101 bp, rice(Oryza sativa)
  misc_feature (71): n=t or g
ctaaacaatttacaaatgtttatgaggaagcacacggccgatgaatcgatgcaaatcctacgatttactanaagtaaggtggtgttctcttctcctataaa

SEQ ID NO: 51229 - DNA, 101 bp, rice(Oryza sativa)
  misc_feature (71): n=a or g
gtatagatggccacaattggatgttcccagtggcctatgctgtctttggatatgaaacaaaggaaaactgngaatggttcatggtttgtttgaataaggca

SEQ ID NO: 51230 - DNA, 101 bp, rice(Oryza sativa)
  misc_feature (71): n=a or g
ctttcggctagctccacaaggtggtggattagacgatctgagttcaaagtctcaactcttctaattatttnatattatttgatattatgtactttcttaat

SEQ ID NO: 51231 - DNA, 101 bp, rice(Oryza sativa)
  misc_feature (71): n=a or g
atggacccagctacgacccgtgtcaccctagacacccccccccggaaaaaaaccctcctaccctcttatcntaccatcaaaattaggtataacaaggtgcg

SEQ ID NO: 51232 - DNA, 101 bp, rice(Oryza sativa)
  misc_feature (71): n=a or g
gaattctcaatcacagtgattttagctatatctccaacttagctgcaagtgagagcaacgatattgtgtcnaatgcaagcatgagttgtctgaattccata

SEQ ID NO: 51233 - DNA, 101 bp, rice(Oryza sativa)
  misc_feature (71): n=a or g
gcttctagtggacgggcctgtaatgaagcccattgaagtccaccacaccagtccagccatcatgtaaaacngatcgttcttttcccgtagtcatcaactag

SEQ ID NO: 51234 - DNA, 101 bp, rice(Oryza sativa)
  misc_feature (71): n=t or c
catcatccccacagagaatttcctacattggaggatgcagatcacatacacaaccgttaatcctaatctanacaatgaaattggtactgtatgtgctggtt

SEQ ID NO: 51235 - DNA, 101 bp, rice(Oryza sativa)
  misc_feature (71): n=a or g
tacaccatcaacgggagtatatacaaacgatgatctctttttccctgcacgtttctcacgctgaagttcanttgaagttttttttttttctaatcattatt

SEQ ID NO: 51236 - DNA, 101 bp, rice(Oryza sativa)
  misc_feature (71): n=a or g
cttgaactagcagagtggtcaaataggagtaggaccacaaatttacctctctagctagttgcttagataantccttttttttttttgttgagattgctcat

SEQ ID NO: 51237 - DNA, 101 bp, rice(Oryza sativa)
  misc_feature (71): n=a or g
atcgcttgctggacatcgagtccacaagtggacatgtgaggatgaaatggccatggagatcgttgccagcntgatggagagccttcttctaggagatccct

SEQ ID NO: 51238 - DNA, 101 bp, rice(Oryza sativa)
  misc_feature (71): n=t or c
tgtaccatataggtagacaagccaccccagcatgtatcccagctgcacggcctgacctattgttaattttncaaagcactgcccatcacaaatagcaccac

SEQ ID NO: 51239 - DNA, 101 bp, rice(Oryza sativa)
  misc_feature (71): n=a or g
tcaattacgattgacagtcaaagcagaagttactcacttacagcttctcctagcaggcccagggatgaacnttctccacgctctcgaagccctttgaccta

SEQ ID NO: 51240 - DNA, 101 bp, rice(Oryza sativa)
  misc_feature (71): n=t or c
ctggccggcgtaaactagccaaaattttattaagcaagagaaaaaggcgtacagtatatactctcccggantttagtcaaaatcaaactgcttttagtttg

SEQ ID NO: 51241 - DNA, 101 bp, rice(Oryza sativa)
  misc_feature (71): n=t or g
gaaaaaagaaaaggcagatatatagctggagtaattagctagggcaatggaagacgggttcctctgcttcngcgccgccatgatggtgtcgtactgcgccg

SEQ ID NO: 51242 - DNA, 101 bp, rice(Oryza sativa)
  misc_feature (71): n=a or g
catgtaaaaaattaatccacgatcttcatagacatgccattatcgctcgttaaaatcgattttcatagacngccaggttaagtcaaccgactgggaaaatg

SEQ ID NO: 51243 - DNA, 101 bp, rice(Oryza sativa)
  misc_feature (71): n=a or g
gatgggtctctctctctcaaaggtctgactcagaggatttcatcaagaaaatattttgttcttttgcagcngaacagcatccttttgattctgaaatgggt

SEQ ID NO: 51244 - DNA, 101 bp, rice(Oryza sativa)
  misc_feature (71): n=a or g
cagagacttttccccgttttctcagttcctttttggtttggcattgtgctctgattgaacaaccaaggctntaatattttttccaaacaattttacgacaa

SEQ ID NO: 51245 - DNA, 101 bp, rice(Oryza sativa)
  misc_feature (71): n=t or c
gtaaggggaacgggcatgaatcgctgcgcacttgctgatggaagatgaagcagtggtgctgtgatgttgcngaagaaccactgcagtccgcgtcatgctgg

SEQ ID NO: 51246 - DNA, 101 bp, rice(Oryza sativa)
  misc_feature (71): n=t or c
cgattgcatttatctaggtattttaacctccaagcaatgttcttggtgctacttacttctgtatcattttncatagaaaacgttatgcttgaaaaatatta

SEQ ID NO: 51247 - DNA, 101 bp, rice(Oryza sativa)
  misc_feature (71): n=a or g
ataaatggtcaaacatgatttaaaaattaactgcattaaaccgtcacgttgcttctcccgttaatccaccncccactagcgaccaagcttattagttatcg

SEQ ID NO: 51248 - DNA, 101 bp, rice(Oryza sativa)
  misc_feature (71): n=a or c
aatattgatacacatcatacctccaatcatcggctgctactgtggcaacttcaacctcaatatcttttacnatcggcttatatccggatgccccttgagcc

SEQ ID NO: 51249 - DNA, 101 bp, rice(Oryza sativa)
  misc_feature (71): n=a or c
aaggaacacccgcgtcttcgacaatgttctatcataggtgccaacagtatggtggagtgaattgggcaagnaggaaggcaatgggttgagaccatggccaa

SEQ ID NO: 51250 - DNA, 101 bp, rice(Oryza sativa)
  misc_feature (71): n=t or c
cgtcataaaaagaccgatggttttcacgtaaagaacacaccacaacgatcctctcaaggactctctgcttnggtacacaacagagtattattactacctct

SEQ ID NO: 51251 - DNA, 101 bp, rice(Oryza sativa)
  misc_feature (71): n=t or c
aaagtttttcctttacttttgattgacttcctttctgttaatctttacactcaacatagaatttttaacanaaaattgtacaaaaaggcatggtaaaatga

SEQ ID NO: 51252 - DNA, 101 bp, rice(Oryza sativa)
  misc_feature (71): n=a or c
catgatttttaaaatcgacccggtcgagacggtcctcgacttaatatttttctgtccaaaataaactgttntagtttattctatgcgcggtcgaccgaaaa

SEQ ID NO: 51253 - DNA, 101 bp, rice(Oryza sativa)
  misc_feature (71): n=a or c
gacatggacattttgttctaacaaatggtgaacctggagctgattagcgtgctgtatggaagatactctcngagagatgtttggagtttgcgaaagaaaag

SEQ ID NO: 51254 - DNA, 101 bp, rice(Oryza sativa)
  misc_feature (71): n=t or c
ggtttacgtgcgtgctcctagcgtcatgcaaggcgttgaaggccgccacgatgttgtccttgatgatgtcncaacatgacttgaagtatttcccagtgaag

SEQ ID NO: 51255 - DNA, 101 bp, rice(Oryza sativa)
  misc_feature (71): n=a or g
agagacaaaagggaaaactgaacacaaatacatagaggctaatgctacgaagggaggaattctccaagtcnccttgcgcctgccatgatccaggttcttgc

SEQ ID NO: 51256 - DNA, 101 bp, rice(Oryza sativa)
  misc_feature (71): n=t or c
ggcgatctccagcacagctgcaaaaccggtgatggctgttagaaggaaagagaagaaagggaaggttgtgnaggtcggccatggcttttcggacagcgaag

SEQ ID NO: 51257 - DNA, 101 bp, rice(Oryza sativa)
  misc_feature (71): n=t or g
ttccttaaagcatgtgggtttcacccctgcagcgttagaaaaaatcactcaccaaaccatcaaagaagtcnatttgcattgatttttgaagatagggagac

SEQ ID NO: 51258 - DNA, 101 bp, rice(Oryza sativa)
  misc_feature (71): n=t or c
agttctagaaaaatgatggatggctcttatcttatctctccttcttcccttcctcttctttgattctttcncgtcccctcttccttctctcaatggtgatc

SEQ ID NO: 51259 - DNA, 101 bp, rice(Oryza sativa)
  misc_feature (71): n=a or g
acatttggatctcaagtcttcgatcagaaacttcgttttgtacttgtgtatgctgtgcttgagaacgacantgatggtccacggtgcttttgtcccttcct

SEQ ID NO: 51260 - DNA, 101 bp, rice(Oryza sativa)
  misc_feature (71): n=t or c
tatgaagaagagagtgaaacctggccgcgccaccatcatcagattcatcaccatctggatgagaagaccancggcctcctacgccgcggcgacgacgacat

SEQ ID NO: 51261 - DNA, 101 bp, rice(Oryza sativa)
  misc_feature (71): n=t or g
tgaggatgtggagggttctggattcggctcgattcgagccgggttttttttggctcgtgcagacataaagntgccggttgataactggcaataggtgccgg

SEQ ID NO: 51262 - DNA, 101 bp, rice(Oryza sativa)
  misc_feature (71): n=a or c
ccgcggtggcaccgctcctctctccccgtcgacgtctcttaggatgcaaatgggttaacccgtgaatttanttataagtcaaatagatgataactaatgga

SEQ ID NO: 51263 - DNA, 101 bp, rice(Oryza sativa)
  misc_feature (71): n=a or c
ctctttcccccaccaacaccaaccccacgcgaccacccccaatcctcgatcaaacgccctaggatttcatngcaagcaaggaaggaggagaccaaatccaa

SEQ ID NO: 51264 - DNA, 101 bp, rice(Oryza sativa)
  misc_feature (71): n=t or c
cttagtagtatctgagagcacaatggaggttagacaaattcatgggttgtccacaaaactggggtaccagnccgaaactaacttaggaaatactctggttt

SEQ ID NO: 51265 - DNA, 101 bp, rice(Oryza sativa)
  misc_feature (71): n=a or g
gtataaggctggcaaagacaatgtggtggcagatgctctgtcaagacttccccaagatcagcttcaaactnaaatatgtaatgcaattacagtggttatac

SEQ ID NO: 51266 - DNA, 101 bp, rice(Oryza sativa)
  misc_feature (71): n=t or g
gagcaagagagttacctacaagaggatgcccaatgtatgcaaggtgtatcctaatttggtgtgggcgtccngaatgaatttcaacctacatcaatcaacga

SEQ ID NO: 51267 - DNA, 101 bp, rice(Oryza sativa)
  misc_feature (71): n=t or c
tggagtaattagctactgttcgtttcttcggcgtcaggagagcggtagctgtaccagtcattaataatagnatataggtttgcattgacaggtcagacaag

SEQ ID NO: 51268 - DNA, 101 bp, rice(Oryza sativa)
  misc_feature (71): n=a or g
aacacagtatgaagatttgagaggttaatccaagggtataaagcaagtggcattaaacacttgacagatcnagcagacggtgacacataaatcctactatt

SEQ ID NO: 51269 - DNA, 101 bp, rice(Oryza sativa)
  misc_feature (71): n=a or g
gggggtgaatacttaaaaaaaaacttcaaatatccttcaaatcatagaagggttgacaatttataaacccnctataagttccaaaaaatgcgaaagttttt

SEQ ID NO: 51270 - DNA, 101 bp, rice(Oryza sativa)
  misc_feature (71): n=a or g
ataggtggtttgggaactctaaatgacactgcacccacagtataagtgtggtttagaaaatttataatggnacccatagataatataaaaaatctcaccct

SEQ ID NO: 51271 - DNA, 101 bp, rice(Oryza sativa)
  misc_feature (71): n=t or c
tgcctccgtttcaggttatttgactttcctgaaacggaggaagtaacaaacgaacgagacacgtgtcgatntgtaaattagaattgagcagcgtttttgtc

SEQ ID NO: 51272 - DNA, 101 bp, rice(Oryza sativa)
  misc_feature (71): n=t or c
aagatttaaggttgggatgatggagcttgattctctgcccttgaagttaatccttactacacctaaaggtntgctgtaccaagcccactttgagctggatg

SEQ ID NO: 51273 - DNA, 101 bp, rice(Oryza sativa)
  misc_feature (71): n=t or c
ctcctctggccctctgctatgttcctctcatctagtgctttaacttcattttttagttcttcatcaacacngatcactatgcatgctcctaaagtgtttaa

SEQ ID NO: 51274 - DNA, 101 bp, rice(Oryza sativa)
  misc_feature (71): n=a or g
ggataagatatttcgtagtacaatgaatctgaacattttatagttatacccaacaaaccccgatagaaacntacatccttatatggtttattaggcatctc

SEQ ID NO: 51275 - DNA, 101 bp, rice(Oryza sativa)
  misc_feature (71): n=a or g
atcgccggaaaccacgatgatgatgacgacgaggaggaggaatgataccgttggctccggctcatctcccnaacggcggcggcgacggtcgccttggatct

SEQ ID NO: 51276 - DNA, 101 bp, rice(Oryza sativa)
  misc_feature (71): n=t or g
agggaggagggagggtggaggaaagggccatggacagcgcaggaagacaagctgctggttgagtacgtgangcagcacggcgaagggaggtggaattctgt

SEQ ID NO: 51277 - DNA, 101 bp, rice(Oryza sativa)
  misc_feature (71): n=a or g
gaagaggaagaagaagaagggatgaatcggagcatattccgggatcgaacgggtgaattattccaacacgnaagcatatatagatttcagatttgtggggg

SEQ ID NO: 51278 - DNA, 101 bp, rice(Oryza sativa)
  misc_feature (71): n=t or c
gtcatcgtgctggcagaggtttaggagtatgtgaagggggcaacgatgtcatcgtcgttgttgtcgggggnggaggtcagggagggatcggaggaggggtc

SEQ ID NO: 51279 - DNA, 101 bp, rice(Oryza sativa)
  misc_feature (71): n=t or c
tacttctgctatctttgcaatggctaagcggaactatgactaactcctctccgtaagcttctttgtaatangtattgctgctgtacttggtctcattatct

SEQ ID NO: 51280 - DNA, 101 bp, rice(Oryza sativa)
  misc_feature (71): n=t or c
ttctctcccgataccttgatacctcgtacttggtacctatgggttatcggttagtacctataggtattagntggtacccgagacatcaaccatgataccac

SEQ ID NO: 51281 - DNA, 101 bp, rice(Oryza sativa)
  misc_feature (71): n=t or c
cgcacagcattgtacgcatcttggtagtatttctttagcattccagctgatacttttggtgccaacggttngtttagtagttcaactgccaggagacttgg

SEQ ID NO: 51282 - DNA, 101 bp, rice(Oryza sativa)
  misc_feature (71): n=t or c
tggaaaaggtaagttgcaatgattgtcatgggaagggattggtcactggtgtattccaccatattctctcngccaaaaaaaaaaatccaatcctagctacg

SEQ ID NO: 51283 - DNA, 101 bp, rice(Oryza sativa)
  misc_feature (71): n=a or g
tagatctgtgtaggggttcgcaatacgacattaggagtagcgtgtagtgatcacctgctttagggttcccngttccctttatatagacacagggaactggc

SEQ ID NO: 51284 - DNA, 101 bp, rice(Oryza sativa)
  misc_feature (71): n=a or g
caccgacatcagtgcaactggagtaggagggaacgacggcacacctggaggaggatggaacgacagcacangagagaacgtcaatatcaatggaggcaata

SEQ ID NO: 51285 - DNA, 101 bp, rice(Oryza sativa)
  misc_feature (71): n=t or c
caatcgccaacgcaagcacgagcaaccgtgagaatttcttcagggctgttcagttcctcaaaactttttcnaaaaacatcatatcgaatctttgaacatat

SEQ ID NO: 51286 - DNA, 101 bp, rice(Oryza sativa)
  misc_feature (71): n=a or g
ttctttgagaagatggtaatgcccataccttgcagcagtcggccaccgttattatcgaagtaccatctacncttccatctgtcatgcaagcatacaagggc

SEQ ID NO: 51287 - DNA, 101 bp, rice(Oryza sativa)
  misc_feature (71): n=a or g
gcatttctgctacagagtgcagcaaaatcacagctcgctgggatcatgtaggtgcgggtgcaagagtcacngctctgcactactatggcatttttgatgtc

SEQ ID NO: 51288 - DNA, 101 bp, rice(Oryza sativa)
  misc_feature (71): n=t or g
ccgatcccgtggcccgtgattgcttgcaacgaccagcagtactggagggaaagtattctaattcctcgagnggatgttttctcgtttgctcaaaaaccatt

SEQ ID NO: 51289 - DNA, 101 bp, rice(Oryza sativa)
  misc_feature (71): n=a or g
aagaaaggctcaacagatactcttaacttcactcttgaggacttggttgggtctcaggctaatgataaggncccttctgataaaaaatagatttctcttca

SEQ ID NO: 51290 - DNA, 101 bp, rice(Oryza sativa)
  misc_feature (71): n=t or c
acggggcatgtcgagtctgagattcgagaaaggcatggagaaagaagctgagcagcagggtttacgattcnaatatgaacttcagtttcgggctctggtga

SEQ ID NO: 51291 - DNA, 101 bp, rice(Oryza sativa)
  misc_feature (71): n=t or c
agcttaaactaaaaatcatttggatcataagctgggggctgtggcccttcatcttcttcatcattttcttnttcttcttcttcttcttcttcttcttcttc

SEQ ID NO: 51292 - DNA, 101 bp, rice(Oryza sativa)
  misc_feature (71): n=a or g
gacgagaactgaggcggaggcatctccaccaagaatcgtcgggcttcgcgggaaaccacccttcacaactncaacaacgacttccaacttcaccaccaaca

SEQ ID NO: 51293 - DNA, 101 bp, rice(Oryza sativa)
  misc_feature (71): n=a or g
tcaacaccattctacaacatgatgggccaaccaatgtctccccatacagcatacttgccaccgcacaatgntcatgcccctttcagcccagttcaacaccc

SEQ ID NO: 51294 - DNA, 101 bp, rice(Oryza sativa)
  misc_feature (71): n=a or g
gatgaagaaatagaagattttaaatccaatcgcaatcgttcgcttcactccattatgactgaggggaaatnttagaagtatagatgttagttagagataag

SEQ ID NO: 51295 - DNA, 101 bp, rice(Oryza sativa)
  misc_feature (71): n=a or g
aaatgggtcctttgccattgaatatggtctggcactgttaaaggaagaaattatatgggggatagggaacngaagaatggtcaagatttggagggaccctt

SEQ ID NO: 51296 - DNA, 101 bp, rice(Oryza sativa)
  misc_feature (71): n=t or c
cttctctatctctattctctactactttaaacactcagttgttctcctccctccctatagcatgtggcgcntgtaaaaaaccgaaccggtccacccatccc

SEQ ID NO: 51297 - DNA, 101 bp, rice(Oryza sativa)
  misc_feature (71): n=t or g
gtataaatctccgcgaccatcatcggattaatcgatgacaattgcagggagacgatgatggagtacagganggagctgaagaagctggcagagaagctgct

SEQ ID NO: 51298 - DNA, 101 bp, rice(Oryza sativa)
  misc_feature (71): n=t or c
catggttgccatcgatgtcgcggaacttgttgttctagtcaatgtcgagctcaacgccgacgaggtggttngtggcgtcgccgttgctgatgtcgttgaag

SEQ ID NO: 51299 - DNA, 101 bp, rice(Oryza sativa)
  misc_feature (71): n=a or g
cagaggacaaaggtacctagtatgtcctgcttctccacactcaaagcaccttccccaccgattaggacaanttgatggaacatggctaccttggcatattg

SEQ ID NO: 51300 - DNA, 101 bp, rice(Oryza sativa)
  misc_feature (71): n=a or g
tctggagagtacatcaaggctgagaaacttgttagctcttccagtgcatgcatattgctgatttcttttgntaatttaacatgataatcaacgaataaacg

SEQ ID NO: 51301 - DNA, 101 bp, rice(Oryza sativa)
  misc_feature (71): n=a or g
ctccccgagcaagatcgagctgccgttccgagtagccgcctacatcaccctttatgaaagctcaagcttcnccttcaacgccctcctgagaagccccttcc

SEQ ID NO: 51302 - DNA, 101 bp, rice(Oryza sativa)
  misc_feature (71): n=t or g
gagcccacgtagaccacccaccctagttttaccgcacattttttcccagctcattcatcagattattttcnttattttttaaaaatatatttaaaaaccct

SEQ ID NO: 51303 - DNA, 101 bp, rice(Oryza sativa)
  misc_feature (71): n=a or c
tcatgatttacgcagaggcctcgaccccggagattgtggggttcgttgagtacacttgatcatttacaccnttatgcgaaacctagaaaaatctaccctgg

SEQ ID NO: 51304 - DNA, 101 bp, rice(Oryza sativa)
  misc_feature (71): n=t or c
agcacagatatccattcctgaactgtgaccaaatgctttgacacaaggagccgatatgactccctcaacgngtcgaaaactgcttcattctcctgagtctc

SEQ ID NO: 51305 - DNA, 101 bp, rice(Oryza sativa)
  misc_feature (71): n=a or c
caaaataaacagctaaatatcctactagtgcataagacaagatgacgaatgcaggcggcggcggcggcggnggaggaggaagggggctcagttgtcgtcgt

SEQ ID NO: 51306 - DNA, 101 bp, rice(Oryza sativa)
  misc_feature (71): n=t or g
caccttcccctgcaccaactgcacaagcgaaaaaaattttcagctcctctcgccatggcaatcggtgattnatcacaggcgtctctcatgcatgcgtgtgc

SEQ ID NO: 51307 - DNA, 101 bp, rice(Oryza sativa)
  misc_feature (71): n=a or c
aagtctaatgagtgaaatgccgtcgtttaattctttctccaaactagcgaaaatatggagcattaaggatncaaacatataggagtaacattaatacatta

SEQ ID NO: 51308 - DNA, 101 bp, rice(Oryza sativa)
  misc_feature (71): n=t or c
gtcctcgattacgggacgcactgagtctgtttcctttggtgaagtctatgcgcaactgctgagtttcgagnagcgtcttggtctccttcaaggaggctctc

SEQ ID NO: 51309 - DNA, 101 bp, rice(Oryza sativa)
  misc_feature (71): n=a or c
agagatctttcctatgacgttttggccccataagtacttcaagtaaaatacctccaaaagaaagcacatcntcctccaaattttccctaaaaacataaatt

SEQ ID NO: 51310 - DNA, 101 bp, rice(Oryza sativa)
  misc_feature (71): n=a or g
aataacgagtgcacgtcaactacacaaattatttccagagtaattcaatcacaacacacacaataatatgncgctctaaaaagtgcataacacataatatt

SEQ ID NO: 51311 - DNA, 101 bp, rice(Oryza sativa)
  misc_feature (71): n=t or c
caccagacccatgcacatcaaggccagtgtcttttggcctttaatcttcccctcccgtccattgaccttcnagaatatggcaattttctctctggcagcga

SEQ ID NO: 51312 - DNA, 101 bp, rice(Oryza sativa)
  misc_feature (71): n=t or c
atttccctctaggtcccaaagccagtgagttttctttgatctccttcttttccctacccgtaccttgattnctaatcaagccacctcgccagaggaggtgt

SEQ ID NO: 51313 - DNA, 101 bp, rice(Oryza sativa)
  misc_feature (71): n=t or g
caactgcacacaacctgatatgtcctaggctgtttccatgttaattctgatgctagacaggcagtgcatanaggacatatagctagctagaccaagggccg

SEQ ID NO: 51314 - DNA, 101 bp, rice(Oryza sativa)
  misc_feature (71): n=a or g
cagcatctccgaggtcaccgtcatggcctccaagatcgcctatgagaacgccgcctacatcgagaacgtcntcaacaatgtctggaaggtatatatatata

SEQ ID NO: 51315 - DNA, 101 bp, rice(Oryza sativa)
  misc_feature (71): n=t or c
ggaataagagacgggttgggtgtgtgcgacaccacatggctactagcagatggggcaggtccgcaggtgangagtgagcttattcctccctccgggcagta

SEQ ID NO: 51316 - DNA, 101 bp, rice(Oryza sativa)
  misc_feature (71): n=a or g
ttttttaaaagatgctcataaaagtaagatgtgtgtgcgcttattttatagataagtgcacgtgcgttatnactgtctgcgtgcgtttgttgtttgttgtg

SEQ ID NO: 51317 - DNA, 101 bp, rice(Oryza sativa)
  misc_feature (71): n=t or c
tgcaatgttttacgttatacgagttgttcaatcaaaatgagtcctatgaacactactgatatacttcctcnattccaaaatgttttaaaaaaagaaataga

SEQ ID NO: 51318 - DNA, 101 bp, rice(Oryza sativa)
  misc_feature (71): n=a or g
atttgctcttatgtattggatttattaccatttggttcttctttgcaaaaaatggatcgtgtcacattaanggggagttttgcactcttgcatgtgctcta

SEQ ID NO: 51319 - DNA, 101 bp, rice(Oryza sativa)
  misc_feature (71): n=t or c
acaagttgatgtgatggaaaaagttggaagtttggatctacacagcatatgtgttggtacggtacatcttncgtggtggaaattcagacaacttttatgtg

SEQ ID NO: 51320 - DNA, 101 bp, rice(Oryza sativa)
  misc_feature (71): n=t or c
gatggatgtaagggaaaagcagttgttgaggcagttggtagtgcaaataagggtaaatcagtagctgaggntgtttgtactacatatgagggtaaaaaagt

SEQ ID NO: 51321 - DNA, 101 bp, rice(Oryza sativa)
  misc_feature (71): n=t or c
actccaaaactatatacatcactcttttcagttagttgtccagtatggtaatactctgggtctaaataacnaaatgtgccttggacaatagtcaccacatg

SEQ ID NO: 51322 - DNA, 101 bp, rice(Oryza sativa)
  misc_feature (71): n=t or c
agaatagcatactaatttagtacttagcaactccctcatcctgtggtgtgatggggaagctcaacctctcncctctgtattttcttttctttttgagagag

SEQ ID NO: 51323 - DNA, 101 bp, rice(Oryza sativa)
  misc_feature (71): n=t or c
aagggtgctagggatttcacctgataacttgttggaatctgcatagaattgaacaagatttttcaagcccncgatttcttgtggtattgatccttccaagt

SEQ ID NO: 51324 - DNA, 101 bp, rice(Oryza sativa)
  misc_feature (71): n=a or g
aggctgaggaaagggggaagacgaaggtggtggggcccacttgaaggaaatatcgcgaattattgtttgcngccctgtgatctagctgccgcacggcggct

SEQ ID NO: 51325 - DNA, 101 bp, rice(Oryza sativa)
  misc_feature (71): n=t or c
ggaaccggcacatatttttccttcacatgctttctaggtgccggttgaaaatccggcatctttataggttnccaaccgacacctattttcttttctgaggt

SEQ ID NO: 51326 - DNA, 101 bp, rice(Oryza sativa)
  misc_feature (71): n=t or c
tgactaccggtgctttgttattcagtactaggggaacgcaccacacttttcaatttttttttgcggggaanacacttttcaaaatttatggtaagatacca

SEQ ID NO: 51327 - DNA, 101 bp, rice(Oryza sativa)
  misc_feature (71): n=t or g
ctttgatacaaagccttgatatcctgacgaataacatcagtctccaacaattcatctctggagccatcganacagacttgattcagcttgaagtcttcagt

SEQ ID NO: 51328 - DNA, 101 bp, rice(Oryza sativa)
  misc_feature (71): n=a or g
tgagcttgagtagctagctaggtatctagcttgctagggttttatggttcatgcaaatgtcgagtagctgngaggtcgcttttgagcatagcttcatacgt

SEQ ID NO: 51329 - DNA, 101 bp, rice(Oryza sativa)
  misc_feature (71): n=t or c
caagaaaactacagaatactgcagaatatccatgacaagcggcaaatgcacatctacaagatgctcgaaangtgcttctcaaactacatatagaaaataaa

SEQ ID NO: 51330 - DNA, 101 bp, rice(Oryza sativa)
  misc_feature (71): n=a or g
ggaggctgacgagtccttttttgcttttatttttgtcccgatgatttactactacttctatgacattactnttagcagtgttttttataaggataagataa

SEQ ID NO: 51331 - DNA, 101 bp, rice(Oryza sativa)
  misc_feature (71): n=t or c
tgtaggtcggagttgaagtttagaactcggccttttttttcatgccaagtggttttagttgtgttctaaanattttgatatgcaaaccatctgtttaaaaa

SEQ ID NO: 51332 - DNA, 101 bp, rice(Oryza sativa)
  misc_feature (71): n=t or c
ggagtaggagcaatttttttgaactatgtaaggtagactacatcaataataatctttctgaatcattcaanagttgggtgtcaaaaactaaggacttgcat

SEQ ID NO: 51333 - DNA, 101 bp, rice(Oryza sativa)
  misc_feature (71): n=t or c
tctgccatggatttgcaaccagaaatggcactgctggcctctttctgcacaacctcgtagaccttgttcangacgaggccattgtccggcaccagtgactg

SEQ ID NO: 51334 - DNA, 101 bp, rice(Oryza sativa)
  misc_feature (71): n=t or c
atagaaagcaccaagattcagaccagatatctgagatggttgacagattgagctcgcatgttaagcatgtnggctgtgttccagcaggccatgagctgctt

SEQ ID NO: 51335 - DNA, 101 bp, rice(Oryza sativa)
  misc_feature (71): n=a or g
atacttgctaggctatctatatcagactctcaataccgcaattaacaagatagcctctggagaattattcngtacagggggtccatggtggttactgcgga

SEQ ID NO: 51336 - DNA, 101 bp, rice(Oryza sativa)
  misc_feature (71): n=a or g
ttctttagcctggaagggtagctaacaaaatgggaaagtgtcaatatgactgttactagtgaattagctcnggaaataattcaattccttgggggtcagaa

SEQ ID NO: 51337 - DNA, 101 bp, rice(Oryza sativa)
  misc_feature (71): n=a or g
cttcggttgaaccgtaggttttctttgcatacgttcattcagggattatgggcttgcttactttgacgttnctaccaatcctattaaattttgatatgagt

SEQ ID NO: 51338 - DNA, 101 bp, rice(Oryza sativa)
  misc_feature (71): n=t or c
tacctggcttgtggcgaccagtcacgcatagcgccgatgggcttggtgttattttttttccttaagaatgngcaggagttagttgtcaacattatacatat

SEQ ID NO: 51339 - DNA, 101 bp, rice(Oryza sativa)
  misc_feature (71): n=t or c
ggcgtatgcatttctttcatcaaattaataaagcgcagctgcgcgcagggcatgcttttttttttctttgnctttttttaccatcttctaagaaaagctag

SEQ ID NO: 51340 - DNA, 101 bp, rice(Oryza sativa)
  misc_feature (71): n=t or c
agccaatccacggccctgacttgatccaattctccattgtttttatgggggaataagttcacttcgggtcnctctatttgtcgcccagactggttttcgtc

SEQ ID NO: 51341 - DNA, 101 bp, rice(Oryza sativa)
  misc_feature (71): n=t or c
tccttccatccactttgacttttgcagtggatgctgatctctgtcagccaaaatgattcagagaaacaacntggctatgtaccacgtgatcagttaatcga

SEQ ID NO: 51342 - DNA, 101 bp, rice(Oryza sativa)
  misc_feature (71): n=t or c
atcttgcagagaaagaggttgtcggaggtttaattaaacattgactggatcgcttgcactgttcgcactgntgtcagtgccgggagattactgtgtacagc

SEQ ID NO: 51343 - DNA, 101 bp, rice(Oryza sativa)
  misc_feature (71): n=a or g
taattactcggatcagaagccactcagatgagatatgcatgatctacatcacccaagatatttatcactcngggtcatattaattgtcgtgttctatacgt

SEQ ID NO: 51344 - DNA, 101 bp, rice(Oryza sativa)
  misc_feature (71): n=t or c
aagaaaagcaaccttgtttttttgggacagctagcacgtactgttgggttgcaaattgaaaaaaaaaatgnttctgccatataatttacaatgtgaaatta

SEQ ID NO: 51345 - DNA, 101 bp, rice(Oryza sativa)
  misc_feature (71): n=a or g
aacgttcaacccagaattggaatgatactaagggcgaatctgtcagcccaagcttgaacaagaaagctggncagctaggattttttttttatttttgaact

SEQ ID NO: 51346 - DNA, 101 bp, rice(Oryza sativa)
  misc_feature (71): n=a or g
cccactggaatgatcatgttaggtggcttcttccatggcatccatgaacttacctatggtgtcgatattcncaaaattcggttaatgggtgtactacaggt

SEQ ID NO: 51347 - DNA, 101 bp, rice(Oryza sativa)
  misc_feature (71): n=t or c
tggtattcccttggcagcaaagacattgggttccctattgtgcactagtcatgatgttggagaatggcggngcgtcatggaggataaaatttggaatactg

SEQ ID NO: 51348 - DNA, 101 bp, rice(Oryza sativa)
  misc_feature (71): n=t or c
cgaattgggatgaggtgcagttatacatgaaagttgcaaccgcgagataacaactgcacgcaaatttggtngtccgtttttatgatcaacggctcagatcg

SEQ ID NO: 51349 - DNA, 101 bp, rice(Oryza sativa)
  misc_feature (71): n=t or c
aatgacaatatatacagtttcaagttccaactcgaaacaaaaacaagcaacaagccaactacactagcganggcaagctctgctttaggccctgctacctg

SEQ ID NO: 51350 - DNA, 101 bp, rice(Oryza sativa)
  misc_feature (71): n=t or g
atgactagcagcacttctttgacgtacaagaaaaccaggacgactagcaacacgggtagacatagggtgtntagagttcatgctaaaattagaagttttat

SEQ ID NO: 51351 - DNA, 101 bp, rice(Oryza sativa)
  misc_feature (71): n=t or c
gcagacacagtagtaagtaccctctctatctcaaaatataaatattatttttagactcagccacggtcttnaatatgctactttgatcaacaatatcttta

SEQ ID NO: 51352 - DNA, 101 bp, rice(Oryza sativa)
  misc_feature (71): n=a or g
gatttttgccatcttttccttctcccacgtatctgccattgcttcagcctcactagaatatgaactcgtcngcgcggaagccaaagatggcatttgatttg

SEQ ID NO: 51353 - DNA, 101 bp, rice(Oryza sativa)
  misc_feature (71): n=t or c
ttgttgatatttatgcacttcttgtgaagcgttctttgcggaatccacaggctgtgtgtatatttaccatnggagatggggttagtgttttatctttctat

SEQ ID NO: 51354 - DNA, 101 bp, rice(Oryza sativa)
  misc_feature (71): n=t or c
gatggatttgcaatgctttttagagcatgggttaagtggtgggtggaaggatggaaggaatggatggtacngtacttattctctggagtgatgattttgac

SEQ ID NO: 51355 - DNA, 101 bp, rice(Oryza sativa)
  misc_feature (71): n=a or g
atcaggcgtctgatagttcgtggagattcacagttagttgtaaatttgaaagagtggtcttgcctcgacgncaatatgatcgcttatcgacaagaggtatg

SEQ ID NO: 51356 - DNA, 101 bp, rice(Oryza sativa)
  misc_feature (71): n=a or c
agtgtggctgtgtttcattacttgtattttgatgtgttttgagtatatatgcatgctttggtgtcctcctnctagttgttggcatgtatggaggacatcat

SEQ ID NO: 51357 - DNA, 101 bp, rice(Oryza sativa)
  misc_feature (71): n=t or c
ttggagtgtcgtcctcctatagacttgtttatagaacttcctagttatgattgatgctgcaattgcttcantgactaatatatttgagcagatgaaagcat

SEQ ID NO: 51358 - DNA, 101 bp, rice(Oryza sativa)
  misc_feature (71): n=t or g
atcagggatttgtcctgacaggttgttttgggccatggctagaacgaccaagttgttcaaatttccaattnccgggggtatgtttcctgtcaaaagattgt

SEQ ID NO: 51359 - DNA, 101 bp, rice(Oryza sativa)
  misc_feature (71): n=a or g
agtgacgtggagaaaaatgtccttcgtgaaccctagactcttgtccccaaaagttaaattggatctgattnatttgtttaaggaaaccaccggcccatgaa

SEQ ID NO: 51360 - DNA, 101 bp, rice(Oryza sativa)
  misc_feature (71): n=t or c
aaccaattgtgctatacatgccctcttcgatcactcactttttttatcctccaaaatctcataaaaatatnatttgaaaggactttcaaaaatagttcatc

SEQ ID NO: 51361 - DNA, 101 bp, rice(Oryza sativa)
  misc_feature (71): n=a or g
gcgcaacattggtacaatacagcttttcatactgcgttgggcaagtcaccatatgaagtgttgtttgctcnaaagccgacgcactttggggtggtggatct

SEQ ID NO: 51362 - DNA, 101 bp, rice(Oryza sativa)
  misc_feature (71): n=t or c
ttacaacaagctgactaatatcaacattctaactgcaagagctcaagtccaactatctcatctcatgtccnaatgaaaattgagggatcctgccattctct

SEQ ID NO: 51363 - DNA, 101 bp, rice(Oryza sativa)
  misc_feature (71): n=t or g
aggctgccaaatgccaaccgagtaggatcaagtggtatgatgggaggatcaatcgacaataatagtgcggnatcaattgaattagtagttggcaaatacag

SEQ ID NO: 51364 - DNA, 101 bp, rice(Oryza sativa)
  misc_feature (71): n=a or g
ccgcactctacaaatcaaatgctagagcaacgaccggatgcgagacatgcccaaaatatatacatatagcnaacaaatgctagagtaggagcatgccggac

SEQ ID NO: 51365 - DNA, 101 bp, rice(Oryza sativa)
  misc_feature (71): n=a or g
acacttgttgcaaaggagaggaaaatgcgacctagtgacagtatggagatgaagatgaagaaaaagaagcnggatgcatcattcgttcaacctgatgagag

SEQ ID NO: 51366 - DNA, 101 bp, rice(Oryza sativa)
  misc_feature (71): n=a or c
ttcctagttgattgaaatacttactgttttttcccatgataactgaacaaaagggacagcagaagtgttcntaagttaagatacttccagaaaatatattc

SEQ ID NO: 51367 - DNA, 101 bp, rice(Oryza sativa)
  misc_feature (71): n=t or c
gttgtcccatttccagtgcctcacaatcttattcactcccttgttaggttcgaggctccattccacttctntgggagcaaatagtggatttaagctacaaa

SEQ ID NO: 51368 - DNA, 101 bp, rice(Oryza sativa)
  misc_feature (71): n=t or c
acctcaccggcaaagctatctccatgcccagactcggtgaggcatttcatcgaacacttgaacctcacacngcagaggcgggttgccgccggcgaagtgaa

SEQ ID NO: 51369 - DNA, 101 bp, rice(Oryza sativa)
  misc_feature (71): n=t or c
actccctccgtcttattaaaaaatgaatttgtatatgggctaagcccaaatccatagctagcagttggctntttgacagagggagtgcatattttgggtgg

SEQ ID NO: 51370 - DNA, 101 bp, rice(Oryza sativa)
  misc_feature (71): n=t or c
cgacgacatcgcgcaaagaatcggccgcaagagattctccgttgccatcttctctctttatttacacacanactcatccgtctcaacatatagtgccattg

SEQ ID NO: 51371 - DNA, 101 bp, rice(Oryza sativa)
  misc_feature (71): n=a or c
gccggaggtgcccatggagattgcagtgccggatgtccaaatggatattaaagtggctgaaccagaggtgnaatttgtggcatcagttgggacagaaatag

SEQ ID NO: 51372 - DNA, 101 bp, rice(Oryza sativa)
  misc_feature (71): n=a or g
tccatccgcgggaagccgcagatgcgctcgccgtagtcgtcgcagcgttccaggttcaagaacatgtcatncgtccaccgcttcggcaacccggcggcctc

SEQ ID NO: 51373 - DNA, 101 bp, rice(Oryza sativa)
  misc_feature (71): n=t or c
cagatggtaggaggcgagccagactttgttgtcctccggcgtgcgttggccccggaagaattgttcacagnggttgaggaaggggagcggatcgccgcggc

SEQ ID NO: 51374 - DNA, 101 bp, rice(Oryza sativa)
  misc_feature (71): n=a or g
gaagacgtagacgcgcatcaatgacgatggcgaaatcctccgatcatgaaaatgcaggaaatagtcgacgncgacaaatgcgaccgatggtaatgacgatt

SEQ ID NO: 51375 - DNA, 101 bp, rice(Oryza sativa)
  misc_feature (71): n=a or c
tcaagtgcgaaactaacctacagttttgtagcactgctatgccaagaaaagagggcctatcctcatccctncaatcttcataccttttatctatcaatcat

SEQ ID NO: 51376 - DNA, 101 bp, rice(Oryza sativa)
  misc_feature (71): n=t or c
tctaatacaaatcacaatatcagtgcagctgctaaatgtaaaatcagaacacatataatcacttgggaaancaacatgctgttcaacctgattcatgaact

SEQ ID NO: 51377 - DNA, 101 bp, rice(Oryza sativa)
  misc_feature (71): n=a or g
catgtaccctctggtccctctgatgctaaacgaggcgggatcatcgagatccctcctctgttgcatcttcncgagcccgaaatcgctgatcttgggctcga

SEQ ID NO: 51378 - DNA, 101 bp, rice(Oryza sativa)
  misc_feature (71): n=a or g
gatcgtgatgccatccttcgccagccaaggctctccacttcttctggcagagtataccttttccgcccttnggatgaaagtctgcatggcatccagtctcg

SEQ ID NO: 51379 - DNA, 101 bp, rice(Oryza sativa)
  misc_feature (71): n=a or c
aaaaaggtaaatgagggattcatcaaagcgatgcaattggtagcaccaccatttcaactacttacactaanctattcttatcttttcagagaaaaggacac

SEQ ID NO: 51380 - DNA, 101 bp, rice(Oryza sativa)
  misc_feature (71): n=a or g
acgactatatgtttcttcaactttccaggggatatggatgggcatgttgacaggaacattactccagatgnccatactatttttcattatcatgagaacaa

SEQ ID NO: 51381 - DNA, 101 bp, rice(Oryza sativa)
  misc_feature (71): n=t or c
tttttctctaaactagatcttagggttggttaccatcaaatcaggttgatggagggtgaggaacacaagantgcttttcaaacccattctggtcactatga

SEQ ID NO: 51382 - DNA, 101 bp, rice(Oryza sativa)
  misc_feature (71): n=t or g
gtgcgtcgggcgatggcggcggcgcagatagggaagaaggcaagcaactacacatgccaagcagctcccancttccctccttccaccacacccacgcgtcg

SEQ ID NO: 51383 - DNA, 101 bp, rice(Oryza sativa)
  misc_feature (71): n=t or c
actagaccaacaagcaaactacagctaagaccgcccaaaaccaagccctacggttgaccaccgatctcaantctagccatgtatttgagattgagagggag

SEQ ID NO: 51384 - DNA, 101 bp, rice(Oryza sativa)
  misc_feature (71): n=t or g
agtcacatctaaacagggtctcactttgctgctgcagaggccaggagagcaagttatctacctcaacagtnttggcatcagagctgagccacttgtcctgg

SEQ ID NO: 51385 - DNA, 101 bp, rice(Oryza sativa)
  misc_feature (71): n=a or g
ataatggatggatttggtggcactgaaccttgaactggtggcgcatgaacctgtaactgtgatgcagatgncggagcaggtggcaatgagttttggacagg

SEQ ID NO: 51386 - DNA, 101 bp, rice(Oryza sativa)
  misc_feature (71): n=a or g
ttttgcagcctccccagataaactagagaagagactggcgacatggaaatgtgggcacctttcttatgggnggaaagcaatcttggtgaattcctcctgac

SEQ ID NO: 51387 - DNA, 101 bp, rice(Oryza sativa)
  misc_feature (71): n=t or c
aatacaacttgactcccgatatagtattcatggtgatttttgttgacgtcgtctacgttcgtgtccccctnctttcattgggctcaaaacccacctctcac

SEQ ID NO: 51388 - DNA, 101 bp, rice(Oryza sativa)
  misc_feature (71): n=t or c
aaagttaataatgtcatatatttaaaaactaagggataaattgttcatgaaggaggaaactccgtaggagnaaattgtgcatgatttgcagaaaatgtaag

SEQ ID NO: 51389 - DNA, 101 bp, rice(Oryza sativa)
  misc_feature (71): n=t or c
aaggtcaaggaaggcaggtgtgcgtcgcttcagctagattgagatggtgcgcaccaaaacataacccatanatagggggtgttttagatacagggggtaaa

SEQ ID NO: 51390 - DNA, 101 bp, rice(Oryza sativa)
  misc_feature (71): n=a or g
gtttcagaagatggaggtattggaggagttgattcgaggaggaacattagagagatgaatggtaaaattanagagacaaatgcaagtcgtgagtcaccccg

SEQ ID NO: 51391 - DNA, 101 bp, rice(Oryza sativa)
  misc_feature (71): n=t or c
tgaacctttttaatgttaagaaaggtgaattacatccccgcgtcctacgtatatattctaggggcctgttnagtttgttgccaaaatcaaccttaccattt

SEQ ID NO: 51392 - DNA, 101 bp, rice(Oryza sativa)
  misc_feature (71): n=t or c
tatttgattggtttgtgcgggtcagtttcatcgttatgacgggtttgtctagatacacaaatgaccaattnagattgtagccaaaataaatcttatcaagt

SEQ ID NO: 51393 - DNA, 101 bp, rice(Oryza sativa)
  misc_feature (71): n=t or c
ctcggggctctatataaaccccgcgctaatttaatccgctgccttcctggaaagggaataatcaaacacgncccgtcacttcgccgcacacatcacagtga

SEQ ID NO: 51394 - DNA, 101 bp, rice(Oryza sativa)
  misc_feature (71): n=a or g
ttgattgacatgtagaccctctagcctcctgtccgtttttcgtgaaaataaagcaaaaaagttgatgatgnagtggcgtgccactctcttttaacagagat

SEQ ID NO: 51395 - DNA, 101 bp, rice(Oryza sativa)
  misc_feature (71): n=t or c
ctctctctcctctcccgtactgtctccttcccagatcgagcgccgtcgacgccgtccatcagctgtgctancttgttcatcaagccgtcgcccgccgccgt

SEQ ID NO: 51396 - DNA, 101 bp, rice(Oryza sativa)
  misc_feature (71): n=t or c
aaactttgcaaaattataatggcatggttctaaattacccatctgaaaatcacatgccatgttctgaatcnaatttgcccatgagctttctgaagctcgtt

SEQ ID NO: 51397 - DNA, 101 bp, rice(Oryza sativa)
  misc_feature (71): n=a or g
ttggataaggagaagagggtcacactggtaatttgtttttttttggcaggtcagcaaaactgcgtgctgcngcacaagagtcgccggttttctcttgcaca

SEQ ID NO: 51398 - DNA, 101 bp, rice(Oryza sativa)
  misc_feature (71): n=t or c
aaccagtcttcacttatgaggaagatcgtagagagtccctacacacccgcaaagcattctaaatagctaanggagatataaattattcgtgtcatcctatc

SEQ ID NO: 51399 - DNA, 101 bp, rice(Oryza sativa)
  misc_feature (71): n=a or g
tacttaattaatctaatgcatctccatttttcgtgcgccctgttcatattgggaagcagcaggaacaaacnaggtcattgtaccatatggttgagttaacc

SEQ ID NO: 51400 - DNA, 101 bp, rice(Oryza sativa)
  misc_feature (71): n=t or c
cgaaaacgaggaacatgtcagagaatgcaggtaataatttctctgccgtcactttctaatactccctccantttaaaatgtttgacaccgttaacttttta

SEQ ID NO: 51401 - DNA, 101 bp, rice(Oryza sativa)
  misc_feature (71): n=a or g
ttgtcgagtcacacctaactgaatttgtggccacatgtagctgacgagactataagaacaagttgaaaatnactgctacctctaattttaaccatatcact

SEQ ID NO: 51402 - DNA, 101 bp, rice(Oryza sativa)
  misc_feature (71): n=t or c
attctattcgatttgaccgggacaacccgatactactctctccgtctcgaaaaaaacaaattctaagtttncgtgtccaatatttaactatccatcttatg

SEQ ID NO: 51403 - DNA, 101 bp, rice(Oryza sativa)
  misc_feature (71): n=a or g
ggcgaagtgtggccatgcaatctcttggtaactaaactgcaggtcttgtatagtgtaacgatggctccagntcatcttccctcttgcgccatccaacaccc

SEQ ID NO: 51404 - DNA, 101 bp, rice(Oryza sativa)
  misc_feature (71): n=a or g
gcgagattaggggatgagcgcaatcaggggatttcgagtgcgattaagagattaggagcgcatggtatttncactaatcagactcccgttagtggacccgc

SEQ ID NO: 51405 - DNA, 101 bp, rice(Oryza sativa)
  misc_feature (71): n=a or g
ttctgatttgattttcgtttgatttggagtggaagaaggggattatatgtacagcggattgatcattgatntggtaaagagtcaaatttggtgtgtgatga

SEQ ID NO: 51406 - DNA, 101 bp, rice(Oryza sativa)
  misc_feature (71): n=a or c
tgatttgctgtaagtacttcatctttattcattttggtttgaggtaacatgactgtggagacgtgatcgtnattcatgtctgcaatgcatggcgaagcgat

SEQ ID NO: 51407 - DNA, 101 bp, rice(Oryza sativa)
  misc_feature (71): n=t or c
ttataacttctgtccctcatctatatctagatgccaaattattcaatctcaatgcctgacatggccttggnctggatcaggattgccaacaaggtaagcaa

SEQ ID NO: 51408 - DNA, 101 bp, rice(Oryza sativa)
  misc_feature (71): n=t or c
aaacctctaggaattgtaaaagttggcccacaagtgtaaaaaaaccctctcatttgcgtcctaaccttgcnggacctcacccatgatcataaaatccagtt

SEQ ID NO: 51409 - DNA, 101 bp, rice(Oryza sativa)
  misc_feature (71): n=a or g
atatttatagctaactattatatgaattgattattagattaactagaaattagaagttagtactccctccntcccacaatataagggattttgagttttta

SEQ ID NO: 51410 - DNA, 101 bp, rice(Oryza sativa)
  misc_feature (71): n=a or g
ccatgtaactttcccagactctattgatttctactgtgggacatcctgggtgggcactggctgcattcctnaccgcagcttctgcagcctccaccccactc

SEQ ID NO: 51411 - DNA, 101 bp, rice(Oryza sativa)
  misc_feature (71): n=a or g
caccgccgtgcgcgcacaccttgatcaggcctgggaactccatggacggcgtggagtagatgcaggtgtcnccgtagctggcgaacgtcgggaagccggac

SEQ ID NO: 51412 - DNA, 101 bp, rice(Oryza sativa)
  misc_feature (71): n=a or g
ggctcgcttggagagattgtgtagccgccctgaatcctgctaaagcactctcgggcaccggggttatacangttcttgccgctgtcgagcataacacccta

SEQ ID NO: 51413 - DNA, 101 bp, rice(Oryza sativa)
  misc_feature (71): n=t or c
agatgatgacaagcagctgcaactctaatcaaatctctgggtttcagtcgaaccagcaccttatacaaganatcatcagggacagaccaaatacccactcc

SEQ ID NO: 51414 - DNA, 101 bp, rice(Oryza sativa)
  misc_feature (71): n=a or g
tttgagtggactaagtaggtcggatgcgattaacaatttactaattggatatctgaagagagcgatcatgngtgagcatatcgcggtgcagtgcagtttgc

SEQ ID NO: 51415 - DNA, 101 bp, rice(Oryza sativa)
  misc_feature (71): n=t or c
agacttcagtcctatcgtctccgcactctgcaccaaatctgatccaatcacggttggggagttgtgttcgnaacttctcaactttgaaaccctccttgatc

SEQ ID NO: 51416 - DNA, 101 bp, rice(Oryza sativa)
  misc_feature (71): n=t or c
atccttttgtgtcaaattcttctgttcctcttatgtcctggtgcttgtatgtccaaagtgtcctttttgtnagtcaacttaacttctgcagaattggtttt

SEQ ID NO: 51417 - DNA, 101 bp, rice(Oryza sativa)
  misc_feature (71): n=a or g
aaaacagcctgataaaaaggttgactggatcaaggagatggccagctgtgatatgttccatgggaattggnttcgggatgagtcgtaccctctctaccctg

SEQ ID NO: 51418 - DNA, 101 bp, rice(Oryza sativa)
  misc_feature (71): n=a or g
cgtagaaaggagtttttgtctaatataagagtggtgtcactgattacaggctgcatcgagtgaatttatcntgaaggacactgggaactgtagtccccgtt

SEQ ID NO: 51419 - DNA, 101 bp, rice(Oryza sativa)
  misc_feature (71): n=a or g
gatgcagaactcagagagagcactacagctgttgaatgtgatgaagaaaagtggcttccatccaaattacnccacttataagatggttatatcttctttct

SEQ ID NO: 51420 - DNA, 101 bp, rice(Oryza sativa)
  misc_feature (71): n=a or g
actcaatataatacccaatgtaacacactaaaattttacacccctcgatcaacaccccctcaatcccttangccataaggtgatttcttccacacatctgt

SEQ ID NO: 51421 - DNA, 101 bp, rice(Oryza sativa)
  misc_feature (71): n=a or g
tgatctagtggaagttgaagtgacagaacaactgttgtcttcgtcgatgatgcgccactggtaattaaacngctcaccatatgtggttatctgcgccctgg

SEQ ID NO: 51422 - DNA, 101 bp, rice(Oryza sativa)
  misc_feature (71): n=a or g
actaaactttaaacttgagagatgtatgaagcttcttgttttgggtgagtggagaaagtgagaaggtgaantctttttatagccgaactatgacggttatg

SEQ ID NO: 51423 - DNA, 101 bp, rice(Oryza sativa)
  misc_feature (71): n=a or g
gcattgtttttcctgaatacaaattcacttcacatagcacattgcatatacatcacttaaaccacagaacnatgcaaatacacagtagcagaccaactaaa

SEQ ID NO: 51424 - DNA, 101 bp, rice(Oryza sativa)
  misc_feature (71): n=a or g
tgtgtattttgctttgccactggcggctagcacaaatgagtgccaaaagtgggatttttgtattagtggcnaataaaagatgaatattcttagtggctaaa

SEQ ID NO: 51425 - DNA, 101 bp, rice(Oryza sativa)
  misc_feature (71): n=t or g
gaaccacttggtagttggtactcccatttgtcacttgcatacaagaagcccaaacagtggcatttttcctnggctgttcttggtttggggtccagtggaag

SEQ ID NO: 51426 - DNA, 101 bp, rice(Oryza sativa)
  misc_feature (71): n=t or c
caaatacaagcacaagaattagtcatgccgaattaaaggctgtcgagtaatgcattgggttaaacttctancctgagaattttcaagctaccgatgattgc

SEQ ID NO: 51427 - DNA, 101 bp, rice(Oryza sativa)
  misc_feature (71): n=t or c
gtaagatgcactaaattcataatttccggcgagcgcacagacctaaattagtcccaaaatatagtagcttncagtattcaaatttttttctaaaataatat

SEQ ID NO: 51428 - DNA, 101 bp, rice(Oryza sativa)
  misc_feature (71): n=a or g
aacaacctaagcaaaatatacctgaagctgctacttggatcaacgagaaaaacagagactaaatcctactnattgaacagatcggaacaaatcacaaccct

SEQ ID NO: 51429 - DNA, 101 bp, rice(Oryza sativa)
  misc_feature (71): n=a or g
gggaccccagacatagccccggatttgttcagagcaatttctgggcgtgctccaggatatctcaaaaatgnccgccgccgcggcggcactggcagcggctg

SEQ ID NO: 51430 - DNA, 101 bp, rice(Oryza sativa)
  misc_feature (71): n=a or g
cactgtagactgatcaacttgaacacagcagaacaaattgcccatagctgcagtccttagatagcttccgnccgtacctgaatgttcatacatcataaagc

SEQ ID NO: 51431 - DNA, 101 bp, rice(Oryza sativa)
  misc_feature (71): n=a or g
ccggtggtttcctttttttctctctgattttttttttcacgagaggagtaactgagctggatagggctttntttgggctcagtgcagtatttgttttcctt

SEQ ID NO: 51432 - DNA, 101 bp, rice(Oryza sativa)
  misc_feature (71): n=a or g
actcatcggtgggtttctgagtgatgcttgtttaccatcattgcggcatctgagaactccatggaatgcanagctcggcagggggattaacaggctgacct

SEQ ID NO: 51433 - DNA, 101 bp, rice(Oryza sativa)
  misc_feature (71): n=t or g
tgtggaacatcattgtacatcatggtcatgtatgaaatgttgacagcttcacatgggctgtgtttagttgnatccaaagtttggattttgattgaaattgg

SEQ ID NO: 51434 - DNA, 101 bp, rice(Oryza sativa)
  misc_feature (71): n=a or g
gaaatataaagtgaattgttcgcatttattctaagctagatgtttgagggggtctcacgtgaggagggatnttggaatataaagtgaattgctcacatttc

SEQ ID NO: 51435 - DNA, 101 bp, rice(Oryza sativa)
  misc_feature (71): n=a or g
ttggtctggcagcgatgtcgtcgactatgtacctactacgacgctcgctgaccttcttgacctggtccatnatatctttgatgacaccgtgaatctgatgg

SEQ ID NO: 51436 - DNA, 101 bp, rice(Oryza sativa)
  misc_feature (71): n=t or c
tgctcagcaaatgcatacacctgggtgtgtctgttctttacggtaataggcacgctcagctcagtggcaancttcataggtcacaacaattcagaaaacaa

SEQ ID NO: 51437 - DNA, 101 bp, rice(Oryza sativa)
  misc_feature (71): n=a or g
attttttctctgattaactgtgttcttttccagctatacattgtacgtgtaatttaacagcatgcctgcanataatgtatgatgatgcaacatatgcttta

SEQ ID NO: 51438 - DNA, 101 bp, rice(Oryza sativa)
  misc_feature (71): n=t or c
caagtaccaacaactgacgttggtgtcccacatattccctgctacatacaccctccgatctcaaaataagntcatttcatttcacatataccaatacaaag

SEQ ID NO: 51439 - DNA, 101 bp, rice(Oryza sativa)
  misc_feature (71): n=t or c
agttccaaactcttcaagtcaaaattaatttttgtcagcttctggattcaaaaggggacaaatggagttanatgtggaactctgcgagttatccttcatag

SEQ ID NO: 51440 - DNA, 101 bp, rice(Oryza sativa)
  misc_feature (71): n=t or g
atggtcatccattggcttcaacgagtaagaaatcaggctgctaccatcgctcgagaacctctggtttattnagccccccaacacaacacaccacctatgtc

SEQ ID NO: 51441 - DNA, 101 bp, rice(Oryza sativa)
  misc_feature (71): n=t or c
gcataaatagatttatatcaacaaatggacataagggaaggaatagtttctggagtattcgtcaccagtancttcgacgtctttcaaagccgagtcccttt

SEQ ID NO: 51442 - DNA, 101 bp, rice(Oryza sativa)
  misc_feature (71): n=a or g
catttctaattcccataggaattcttaatataagacattgtaattctatgtagtggcagagccacctctcnggcaggtcgggtaactgcccaggattcgct

SEQ ID NO: 51443 - DNA, 101 bp, rice(Oryza sativa)
  misc_feature (71): n=a or c
ctaaagacgcgcagccgtttgaactttaggaatatgtcatctgggattacaatttcgtcaagtccatgacnaatcacaatgatagctttgagtgaatctga

SEQ ID NO: 51444 - DNA, 101 bp, rice(Oryza sativa)
  misc_feature (71): n=t or c
gcagcaccttgtgccgttcgttggtgcacaaggaggtaatctcgactaccttgagacattgccatctccanggctgctcaccacccaccttcctctctccc

SEQ ID NO: 51445 - DNA, 101 bp, rice(Oryza sativa)
  misc_feature (71): n=t or c
tcatacatgtggcaaagcccgtgttcgaccggtttgctgtgattttcaccattgctattgtgtggctgtangcatacattctaactgctagtggcgcatac

SEQ ID NO: 51446 - DNA, 101 bp, rice(Oryza sativa)
  misc_feature (71): n=a or g
caattggatgctgaaatggaaattggaatgcaggagctatgaggaaaacatcgtcggagatggagatctantggcataagaggcgctggagatggagttat

SEQ ID NO: 51447 - DNA, 101 bp, rice(Oryza sativa)
  misc_feature (71): n=t or c
ttggcaacgaggtgtacaagcccatcatttctttctgctaaactttgcaagactcgtcccctggtagtagnagcagctatggaggtctcgaaggaagcccc

SEQ ID NO: 51448 - DNA, 101 bp, rice(Oryza sativa)
  misc_feature (71): n=a or g
ggtatattgaattgaatgattgttgttttagggagtgggtgtctatattcctagcccagtcctttcacatnggcaactctatgttgcgttctcacgtgtga

SEQ ID NO: 51449 - DNA, 101 bp, rice(Oryza sativa)
  misc_feature (71): n=a or g
aggtgctctttcaaacttgtgataataaataatgacatcgtcatctagccgcctaactagacaaaccagcntttgatcttttttctgtacctcctctgggg

SEQ ID NO: 51450 - DNA, 101 bp, rice(Oryza sativa)
  misc_feature (71): n=t or c
gtaagtgtataggttgttatgatctacactgccaagagctttcaccaattacaagaactaaccttgcaacngaaaggtagaactttttctttgggtaggta

SEQ ID NO: 51451 - DNA, 101 bp, rice(Oryza sativa)
  misc_feature (71): n=t or c
tgccttaattcatggtctcgtattgatatagtcgtgctcctcaagtaggccagttaagctctattttcaanggtaacctgtaaaatcggaccacctcaacc

SEQ ID NO: 51452 - DNA, 101 bp, rice(Oryza sativa)
  misc_feature (71): n=a or g
ggatacaatattttgatcagtacctccatgagcttaagagggcgatcaaggatggtgcaagggtcactggntattttgcttggtccctgcttgacaacttc

SEQ ID NO: 51453 - DNA, 101 bp, rice(Oryza sativa)
  misc_feature (71): n=a or g
atggaggccttgtcggcggctgaggcgagaagggcaagaaggaaaatccaaaagggatgaggcagggaagncgggaccatgagccgtggcttaggaaaagg

SEQ ID NO: 51454 - DNA, 101 bp, rice(Oryza sativa)
  misc_feature (71): n=a or c
tgtggcttttgggtctgcataagaatttcagatctcagtgggaaaaaaatggaatgcaacaaaagatgcancatgttccagagttgcgtgtcaaggactag

SEQ ID NO: 51455 - DNA, 101 bp, rice(Oryza sativa)
  misc_feature (71): n=t or c
tgcatagctcgatgattgagttagtttgattattaatctattaatgactagaaaaagtgtccatgcgttgnaacgggaaaaactaaaaactagaagtacac

SEQ ID NO: 51456 - DNA, 101 bp, rice(Oryza sativa)
  misc_feature (71): n=a or g
ataatgtgcggtgttcatgtcatttccaggggtatgtacccgcattgatattttaagttccactactgatnatctttgtgtcccagcaaatctcttggaaa

SEQ ID NO: 51457 - DNA, 101 bp, rice(Oryza sativa)
  misc_feature (71): n=t or c
ttgaggaatgtttcatcagcttgcaccagcaagcaacaatctcaacacgagttcaccatcgatgatagaantcaacaagaagcttgaaacaaacaaacagc

SEQ ID NO: 51458 - DNA, 101 bp, rice(Oryza sativa)
  misc_feature (71): n=a or c
cacacgaattttataggaatccccacatctaaaaacacacatcacagaattcctataaaattcctgcgttncaaaggaggccttgtggcacgtagccgaga

SEQ ID NO: 51459 - DNA, 101 bp, rice(Oryza sativa)
  misc_feature (71): n=t or g
gcatgtttagtttacaatctagtgctactaagattacattacacgtagaaaacctgcccaacattgagcangctctcatgaggcacattgaagatggcact

SEQ ID NO: 51460 - DNA, 101 bp, rice(Oryza sativa)
  misc_feature (71): n=t or c
cttataacattgtcgcgcagacagtcactgacaagtaggtccactgtagatttcaccgataagtggaacangacactttcctaaaaggctaagaaaaaccg

SEQ ID NO: 51461 - DNA, 101 bp, rice(Oryza sativa)
  misc_feature (71): n=a or c
tagctgtcatagatctacccactagattttgctgacctcaccactgtccataccttcccaatgttgcattntttccactgtttgctgagaaagtgtcccat

SEQ ID NO: 51462 - DNA, 101 bp, rice(Oryza sativa)
  misc_feature (71): n=a or g
ggtcataatagtactggacaagtagccgtatagatgaacaaagagcttaatccacataccagttaacatgngatggaacgccacggctattctacataaac

SEQ ID NO: 51463 - DNA, 101 bp, rice(Oryza sativa)
  misc_feature (71): n=t or c
tccttgtcgcccattgggataccaagtacagacttcactgactcctcgttcacatctatggctccacgtcnagggaatacaagctgattggttgctggatt

SEQ ID NO: 51464 - DNA, 101 bp, rice(Oryza sativa)
  misc_feature (71): n=t or c
ggtgttctaatatatggctacttaattgtgtctcgtgggtgctatatttttggcaaaatttattatagganaccgaaaaattgcggtctttgctgtgagac

SEQ ID NO: 51465 - DNA, 101 bp, rice(Oryza sativa)
  misc_feature (71): n=t or c
catgcaagaagagtgttctctttgttgtctctgaacctgcctgtctaggatgcccatcttggtacccagtnggcaccttgcaaggacgttgcaatattgtt

SEQ ID NO: 51466 - DNA, 101 bp, rice(Oryza sativa)
  misc_feature (71): n=a or g
ttctagggaaggacatgcattctgggatgagaatgggtgtgtagtttccccttgctggacaacaatagcancatcactactactaccaccaccaatactag

SEQ ID NO: 51467 - DNA, 101 bp, rice(Oryza sativa)
  misc_feature (71): n=t or g
gcattgccctacctgacatgaatttgaagatgccaaaggctatttgtgtgagattctcatggaacttaaangaggcagtatgctgacccaagatgtggtgc

SEQ ID NO: 51468 - DNA, 101 bp, rice(Oryza sativa)
  misc_feature (71): n=t or c
gaaaaaggttgattcaggagatgctatccaatttgttaaggaacacataatcaatcgatttggtattccgnagaccattacaaccgatcaaggctctatat

SEQ ID NO: 51469 - DNA, 101 bp, rice(Oryza sativa)
  misc_feature (71): n=t or c
cagtttatgatttcagccaatgagattggatgaccatgcatgccgagattggattttttttttttagtgtngtcagatcaaaaactaaatatgtgctgcga

SEQ ID NO: 51470 - DNA, 101 bp, rice(Oryza sativa)
  misc_feature (71): n=t or c
cctctccaccagtttctatatcgtcgaatacaacgatgacgagcaggtgacattcgactcagactcagttnggcagctctcagcgccaaacatggagacct

SEQ ID NO: 51471 - DNA, 101 bp, rice(Oryza sativa)
  misc_feature (71): n=t or c
gacagataagtccacacgaatcctaaagaaatcatgtttgttccgcccatcgtcacccacatccacctccngaacttgtcccaatttgctgccgtataatt

SEQ ID NO: 51472 - DNA, 101 bp, rice(Oryza sativa)
  misc_feature (71): n=t or c
ataaaacatatagttttgtgaaatttactcttttttttttgccatacacagacggaaaagagggatgtagntttgttctaatttgttcagacgtctgctat

SEQ ID NO: 51473 - DNA, 101 bp, rice(Oryza sativa)
  misc_feature (71): n=a or g
tgtgtgcctaccagcccagaatggtggtacgccacaaaggaggatgtagatgatgacgccagcgctccacncatcagcttgctgcccataattccctctca

SEQ ID NO: 51474 - DNA, 101 bp, rice(Oryza sativa)
  misc_feature (71): n=a or g
taagttatttctgttatataactggctttttgcacaaccagttcctacgtatgttcctcctcaagtaccanatatcaagacttcgccagaaaggaaaacaa

SEQ ID NO: 51475 - DNA, 101 bp, rice(Oryza sativa)
  misc_feature (71): n=a or g
agaactccacgaggcaggaattcatttcaagttgagtgatagaaagggatttgtagggggggtcagctttnaaggaggtgtactcagtattcctcgggtcc

SEQ ID NO: 51476 - DNA, 101 bp, rice(Oryza sativa)
  misc_feature (71): n=a or g
aaaaaaaaacttgaggtatatggtctacacactcacacaaaaaagaattgtgctaacaactctacaaaacncatactcaactagtcaactctatgtttata

SEQ ID NO: 51477 - DNA, 101 bp, rice(Oryza sativa)
  misc_feature (71): n=t or c
atgatggatcaatggtgttcagactcgagatgagctgttgttgcacttgcacactaggatacgcacaaacnaaatgcggccgtagtagttaaaagagttgc

SEQ ID NO: 51478 - DNA, 101 bp, rice(Oryza sativa)
  misc_feature (71): n=t or c
taaaaaaatggccacctacattatactccgcttcacctgtcatatctgcaattgagccacagctaaattcntcttcaatgactgattcattaaaagaggta

SEQ ID NO: 51479 - DNA, 101 bp, rice(Oryza sativa)
  misc_feature (71): n=t or c
ccatatagatgtcggatttctcaacgacccttcagacggtactaatgaggaggaatcagatgggccggttnataaatcggtacctttttatcccatgaatg

SEQ ID NO: 51480 - DNA, 101 bp, rice(Oryza sativa)
  misc_feature (71): n=t or c
cactcctcaatagcagaacgcagcgcccgatttggaacgagtttcttgtgttcaagttcaacattggtaantggtgatgtgttatggcctctgcggaacca

SEQ ID NO: 51481 - DNA, 101 bp, rice(Oryza sativa)
  misc_feature (71): n=t or c
accacgatcacgaagtttgttactccaatggcatactccaagataccgcgcagtgcaatgttcatccctcnttcatccatcggttctatgaaaattcttaa

SEQ ID NO: 51482 - DNA, 101 bp, rice(Oryza sativa)
  misc_feature (71): n=a or c
tacaccatgcttttggtctcaatcgcaccaatcttgatgtgtatcttggctttgtaaatctatggttgagnttaaaatcttgacttagttgtcaactactt

SEQ ID NO: 51483 - DNA, 101 bp, rice(Oryza sativa)
  misc_feature (71): n=t or c
gtaacaaagcttgcagtgcttagctttgtccttctcatgagcattggcttaacccatgctgccagggtggntaggtatgccaatgctcagggaacaggttc

SEQ ID NO: 51484 - DNA, 101 bp, rice(Oryza sativa)
  misc_feature (71): n=t or g
acttggatttccatttattacgaggtagtccaaatgatcaatgtgagcagcagaagtatcaattgatgaangatcaatgtgagcagcagaagtatcaattg

SEQ ID NO: 51485 - DNA, 101 bp, rice(Oryza sativa)
  misc_feature (71): n=a or g
ccccacgccggcgaggagcggcgacacggggccccagaagcggttgtagctcaggtccaccacctggatcntcacgtcgttcgccggctggaggaggccgg

SEQ ID NO: 51486 - DNA, 101 bp, rice(Oryza sativa)
  misc_feature (71): n=a or g
gttagcagagctgctccgtaaatttgtattacggggtgaagctggattttcgttgctccacaacttcattncacctcaaaagacccataattaaataagga

SEQ ID NO: 51487 - DNA, 101 bp, rice(Oryza sativa)
  misc_feature (71): n=t or c
aaatcgcacggtttagaagattgggaagcatatatacccccaataatccataagccaaaaagaacgggacnaaattgttgtagcaaacaacctgacaaatt

SEQ ID NO: 51488 - DNA, 101 bp, rice(Oryza sativa)
  misc_feature (71): n=t or c
aataatttcgatttgtacgttaatttatttgtctctgtcgtgaaaaccgcacttccctatcgatctagagngtaataatttataaacgatggatatgttcg

SEQ ID NO: 51489 - DNA, 101 bp, rice(Oryza sativa)
  misc_feature (71): n=a or g
aaaagaacatctttaattgctcggtcatcggaggtaaaaaaacaattcgcatctggttagcgtcgtctggntctggccggggtgagggaattcagcgttcc

SEQ ID NO: 51490 - DNA, 101 bp, rice(Oryza sativa)
  misc_feature (71): n=t or c
acgcctacctaataatagtccatccatccaagctagcctacccctttacatcaaatatatttggcactaanacatcacacatacagagatataatatattc

SEQ ID NO: 51491 - DNA, 101 bp, rice(Oryza sativa)
  misc_feature (71): n=t or c
gaataaatctattttgcatccctcatctctttgggccgtggttatatggttagaataagtttatttacccncctcatctatttttacctctctgatcattg

SEQ ID NO: 51492 - DNA, 101 bp, rice(Oryza sativa)
  misc_feature (71): n=a or g
tggcgagtgggccattgttggtggcactggggagtttaatatggcatatggcactattgtgcacactatgntcaagcataatgttggcaccgaggcactta

SEQ ID NO: 51493 - DNA, 101 bp, rice(Oryza sativa)
  misc_feature (71): n=t or c
atgtgatataaatgtgataatcataacaagtgataaccttgatgcacgggaaaaaggggggctcccatggnggactgctaggcgactggctccgctcttgc

SEQ ID NO: 51494 - DNA, 101 bp, rice(Oryza sativa)
  misc_feature (71): n=a or g
tatcagtgtgtcaaactacatgagtttcacttcaatccatcttccagccccatcatttggcttattcctcnaataaaacttttatatatgtgttcttaacg

SEQ ID NO: 51495 - DNA, 101 bp, rice(Oryza sativa)
  misc_feature (71): n=a or g
acggacctcgctgattagttgctctagacggaaacggattcgatttacatggcggggttgtttgatggggnaaacgctttgtagacgatatcagtacgaat

SEQ ID NO: 51496 - DNA, 101 bp, rice(Oryza sativa)
  misc_feature (71): n=a or g
tgttgctaagaaagcacttgaggcaatttgcgctcaatggaaaaaatccgtcgaacatatagctaaactcnagaaagaccaagaattccttcatcgtgagc

SEQ ID NO: 51497 - DNA, 101 bp, rice(Oryza sativa)
  misc_feature (71): n=t or c
gacaataccacctagaattaaaaaaccttgccgcagtttcgacttgttttttcctacacttccaacaaatncatcactcacctccaatattaccatatata

SEQ ID NO: 51498 - DNA, 101 bp, rice(Oryza sativa)
  misc_feature (71): n=a or g
tatagcttcctgtagtttgtagctagagatcgatcgatcgagcagttagcacttagcaagcctatctagcnagatcgattatgcaattccagttctaccta

SEQ ID NO: 51499 - DNA, 101 bp, rice(Oryza sativa)
  misc_feature (71): n=a or c
atggacagaattttgaccatgcaaggttcttcgacctaatcctgtgcatgcagcaagtaaacacatactanattaacaccaacatagcacaaaggtaatcc

SEQ ID NO: 51500 - DNA, 101 bp, rice(Oryza sativa)
  misc_feature (71): n=t or c
tcatgtgatgcatgcatctgatcgattctgatcaggtcggccagggacatgaaagaaatgatttactcccncacttccaaaatgtaaaaatatagtattgg

SEQ ID NO: 51501 - DNA, 101 bp, rice(Oryza sativa)
  misc_feature (71): n=a or c
aaaaatcatagcaaacaaaacaacggccaattccatccttaccaatttatcttgatgtgttggcacggtanaaagaccaaaatcggcccaacgtttttcca

SEQ ID NO: 51502 - DNA, 101 bp, rice(Oryza sativa)
  misc_feature (71): n=a or g
ttgcacattccgaactgcttcccacaaacggaccagttgctcggcgaggttgattgtgataggtgaggccncatcaagggtcaggtcatgcacccaggcgt

SEQ ID NO: 51503 - DNA, 101 bp, rice(Oryza sativa)
  misc_feature (71): n=t or c
ctccagtccacggacgcaggcaaagcatcggcactaacattctcatacttgaacccagttgataccctaanaccattattaggagtactgaaccccttgct

SEQ ID NO: 51504 - DNA, 101 bp, rice(Oryza sativa)
  misc_feature (71): n=a or g
ttgcttgtggttaatttactttcaagggtatctgcacatcgagtacccgatgcagtttcagattcagaacnccaccacgctgcagacctcgtactgcggcg

SEQ ID NO: 51505 - DNA, 101 bp, rice(Oryza sativa)
  misc_feature (71): n=t or c
tattcatagccaggttagaaatcaatttgcatagtttagtaacaacaacataagattacggcttgtgtatnggcacatggttaacataaacatagatagtt

SEQ ID NO: 51506 - DNA, 101 bp, rice(Oryza sativa)
  misc_feature (71): n=a or c
agattacaagcaatttatttatatacatccaaacattgctatatggttggctgatgcacctcaatcggtgntagaagttatggaggaagttgccaaaaatg

SEQ ID NO: 51507 - DNA, 101 bp, rice(Oryza sativa)
  misc_feature (71): n=t or c
caaaacacaaccaatttcatcgattgttgagttcataaagtggatgcgtatgttgatagtaatattccaantaaatgaataataaagcttagccacaagtg

SEQ ID NO: 51508 - DNA, 101 bp, rice(Oryza sativa)
  misc_feature (71): n=t or c
cagaaaagagtagtatattttttgtgaataattaatctgtatttacttgcaggcatatctgttgcatatgntgctccaagaagacatccattgatttgtgt

SEQ ID NO: 51509 - DNA, 101 bp, rice(Oryza sativa)
  misc_feature (71): n=a or g
agtcccagcttgtatcgagcacctagtgactgaaggttgtaattctgcagtttcttgatgaatgaaatganctctgaataacaacaacaacaacaacaaca

SEQ ID NO: 51510 - DNA, 101 bp, rice(Oryza sativa)
  misc_feature (71): n=t or c
aaaatgtacaaagggaaatgaaaatgacttataagagagattaacactgttgggagtgaatctacgttggntcatgattcccatcgtcccattcagattgt

SEQ ID NO: 51511 - DNA, 101 bp, rice(Oryza sativa)
  misc_feature (71): n=t or c
aagaatatgaagatattagcatgttcaatcttccgagttctgaaaaggaaaaagaatctgctcgctacttntcttgtttttcaggagaagtgcttctgttg

SEQ ID NO: 51512 - DNA, 101 bp, rice(Oryza sativa)
  misc_feature (71): n=a or g
cagaaagaagattaaagaaaaaaaaaattcgatgcacactggtgatcttcacatgacgtggcagccggcgntgtcgtcgtcgccgtacatgcagcactcgt

SEQ ID NO: 51513 - DNA, 101 bp, rice(Oryza sativa)
  misc_feature (71): n=t or g
attgtctctgtgcatgcacttgtgtttgctgcactacgacacatgcacaagcttgtgtaaggacaacatgncttgttgttcttctctcctccggctgatga

SEQ ID NO: 51514 - DNA, 101 bp, rice(Oryza sativa)
  misc_feature (71): n=t or c
attatatttggacatcgtctgttattgaattcgccaggtccaccggtcatagagtcattcctcatgatctngcaagtattatttgcatgcaaaattaacgc

SEQ ID NO: 51515 - DNA, 101 bp, rice(Oryza sativa)
  misc_feature (71): n=t or g
tcatagcacgtgcacctgtgaggggatttgttcctgcaaaccccgctttgcgaaaatagcgtgttatcacnggatttttaaaagttatatgcaagttacat

SEQ ID NO: 51516 - DNA, 101 bp, rice(Oryza sativa)
  misc_feature (71): n=t or c
acacgtcgattattaagcccggagatgatcgtgatttttaccgtgatacggcacgtatgccagctgttaantggacctccctttggatttcctcggaggtg

SEQ ID NO: 51517 - DNA, 101 bp, rice(Oryza sativa)
  misc_feature (71): n=t or c
gtatgcgagaccaaatcaccaagtcgtgctgctagtctcattgccaaaggtttggatataacctttgccanagagtggatcagactaatgggtctgaagtc

SEQ ID NO: 51518 - DNA, 101 bp, rice(Oryza sativa)
  misc_feature (71): n=a or g
tcattacatgttcttttttaacacgatgaatgtaaagttaaaggcgcgtaaaacacaacaaactattagcnaatgattaattgaattttaattattacaaa

SEQ ID NO: 51519 - DNA, 101 bp, rice(Oryza sativa)
  misc_feature (71): n=t or c
aagttttttttattctatcatgggggagtgattatgtgaaatcaacttttggtctgactgctaattactantacctccgtttcaggttataagactttcta

SEQ ID NO: 51520 - DNA, 101 bp, rice(Oryza sativa)
  misc_feature (71): n=a or g
ccatatatatcggcatgtgagggaacaagtggtacgatacctgagtttcttaactagctatcggccaaaantggggtcatttgggcatcgtgtaaaatcca

SEQ ID NO: 51521 - DNA, 101 bp, rice(Oryza sativa)
  misc_feature (71): n=a or g
aacagggtcagttcacagtcgtcttaggcccggttagatggcaaaaatttttattttgggtgtcacatcgnatatacggacacacatttgaagtattaagt

SEQ ID NO: 51522 - DNA, 101 bp, rice(Oryza sativa)
  misc_feature (71): n=t or c
tatttactactagtcacttataagcaagcgattatagtcgatgccattaaggcgttaactgctaccacganaacagataggttcgatgatgcgtccatctt

SEQ ID NO: 51523 - DNA, 101 bp, rice(Oryza sativa)
  misc_feature (71): n=t or c
aaatcaatctatctctaaaaaaaatcccacgttaccccctgccgtgtcccaatggacctgtacgttcttangtaagtatgtatatatcccctatatgtctt

SEQ ID NO: 51524 - DNA, 101 bp, rice(Oryza sativa)
  misc_feature (71): n=a or g
aatttagggggttatttggactttctcctatgaaaattgagtactagtacgaaactgtgaaggctcctgcngatactaaaatccactgaaagctacgttga

SEQ ID NO: 51525 - DNA, 101 bp, rice(Oryza sativa)
  misc_feature (71): n=a or g
gggcgtcactcccaagtcccgggtgtcttctagctggctgcctatgccaccgtcgggtgacctcatccccntgttggctggctcctctgccgccggctggg

SEQ ID NO: 51526 - DNA, 101 bp, rice(Oryza sativa)
  misc_feature (71): n=t or c
atttctaacatgccattgctagttatttgtggtcatatttaacaacgatgggcttatattcaggaatgcangggcttactgcctatgttggattctttgag

SEQ ID NO: 51527 - DNA, 101 bp, rice(Oryza sativa)
  misc_feature (71): n=t or c
caaatatctagtaatgttgattggatactgcacaaacaagaatcatttagccctcatttacgagtacatgncgaatggaagtctgtttgatcatataagag

SEQ ID NO: 51528 - DNA, 101 bp, rice(Oryza sativa)
  misc_feature (71): n=t or c
aaaaaccacaggaaatttgtcggactgattgttcggacggagtataaccgaattatcatctaccagtgctnaaataattggaactaagcaataaccattcg

SEQ ID NO: 51529 - DNA, 101 bp, rice(Oryza sativa)
  misc_feature (71): n=a or g
cgcagctagatctaggtgcgtactacatgatctgtttattcatttatttcatcggcgctcgcggttggccngcccgacggcagaggcgacatacgtaaacc

SEQ ID NO: 51530 - DNA, 101 bp, rice(Oryza sativa)
  misc_feature (71): n=t or c
ctgttattttcttttttccatcttttttcttttcctccgtccctttttttttcgggcttaggtttttttcngccgtttttcttttcttatttcgttttttc

SEQ ID NO: 51531 - DNA, 101 bp, rice(Oryza sativa)
  misc_feature (71): n=t or c
aaacttccaaaccttcattaacagtacatgtgtacaattattctcagtaataattcaccctctgtattttnttttcaatggctcaatttatttcttccaga

SEQ ID NO: 51532 - DNA, 101 bp, rice(Oryza sativa)
  misc_feature (71): n=a or g
ctgaaatgtaacatttaacagtatgaaaaacatgctaacggacatgcgataaaatatgcatctttaatcanaataatcaaaaaagaatggagattcttcta

SEQ ID NO: 51533 - DNA, 101 bp, rice(Oryza sativa)
  misc_feature (71): n=a or g
tgtaacatagtggagtactcgattgatggtcaggaagatcaactgcccatgagctaagctctgccgaacangtaagcttagcaaattgcaaaccgcaagaa

SEQ ID NO: 51534 - DNA, 101 bp, rice(Oryza sativa)
  misc_feature (71): n=t or c
tgattctgccatgggaggccattctggggaaagggcaacatatcaacgactgaaacaactcttctattggnctggaatgaaagccgcagtagctcagtttg

SEQ ID NO: 51535 - DNA, 101 bp, rice(Oryza sativa)
  misc_feature (71): n=a or g
cactagcgaggaggaggccgaggtatcaaaggatagccattaagatatcccactataggagatatgagtcntatcaacgttagtgagagagcacatatgtc

SEQ ID NO: 51536 - DNA, 101 bp, rice(Oryza sativa)
  misc_feature (71): n=a or g
ttaacttcagtcatatttttatgaacaatttccctgtgatctattgagactccaggaacttacaggagggntgccacctattagtctgtccaacatgtcgg

SEQ ID NO: 51537 - DNA, 101 bp, rice(Oryza sativa)
  misc_feature (71): n=t or c
tcattgcatatttgcacttgatttgctgcttgcaggtatatggccaaaatggttagtcagtgtatctctcngcggcagtcctttcgcgttcctcgtttttc

SEQ ID NO: 51538 - DNA, 101 bp, rice(Oryza sativa)
  misc_feature (71): n=t or c
caaatcattctgatacatgtattccttcttacaggtcttcacttgtgttgcactgttcaacacattgatancaccattaaactcattcccatgggttatta

SEQ ID NO: 51539 - DNA, 101 bp, rice(Oryza sativa)
  misc_feature (71): n=a or g
gaggtaggccataagatttttttagctggcatgcatcatcatatggtaatgaagcataatggagcatggcnaagccatgagaagcatagcgagacatggca

SEQ ID NO: 51540 - DNA, 101 bp, rice(Oryza sativa)
  misc_feature (71): n=a or c
tcacaactgcacttaagaacgggacgggagagtaccaatgtgcgtgtaatatgagcgaatacgtaagtacngcgcgtttccagaaaaaaagaattaaatac

SEQ ID NO: 51541 - DNA, 101 bp, rice(Oryza sativa)
  misc_feature (71): n=a or g
tcaatttaataattaacccataatagctcttgttccgctcgataaaactcaaagctcttatattgcctacncattgtaaactgaaactaagctctcatatt

SEQ ID NO: 51542 - DNA, 101 bp, rice(Oryza sativa)
  misc_feature (71): n=a or g
cagttctccctgactgatttgcaaaactagtgctggtacttgtgattgacttccttttcctaccttgtgtncagtttgacagtactaaaccctcttctggg

SEQ ID NO: 51543 - DNA, 101 bp, rice(Oryza sativa)
  misc_feature (71): n=a or g
catcatatatgttgccagctccctgatcatcatgcatggtaggtatcactaaaatggatttcatcgcatgnctttgataccagttgtatgatatataatta

SEQ ID NO: 51544 - DNA, 101 bp, rice(Oryza sativa)
  misc_feature (71): n=a or g
tcacccgtggcccacaacgagaccaaaattgagggtgttgacgctgattcaggtcacatttttactatcancggagggcatgcatttacaacacgaattga

SEQ ID NO: 51545 - DNA, 101 bp, rice(Oryza sativa)
  misc_feature (71): n=t or c
ggacataggcaaaggcgtaggctggaggcaagtggcgaaggtcgaagggacaacataggtgaaagccaaanagcaaaagccgtagcatcaagttgacaagc

SEQ ID NO: 51546 - DNA, 101 bp, rice(Oryza sativa)
  misc_feature (71): n=a or g
aatgggattaaatgtgaatttttgcaatttatgcatatcagggaagctggaaaggggtgctcaaatgaganaccatttttgcttcttcagaagatgacgcc

SEQ ID NO: 51547 - DNA, 101 bp, rice(Oryza sativa)
  misc_feature (71): n=t or g
ccagtataggcccatgcgacgccacgccaggtcccgctcatctcttcaacagaaattagatggagataaanattttcgtgacacgttttttaaattactaa

SEQ ID NO: 51548 - DNA, 101 bp, rice(Oryza sativa)
  misc_feature (71): n=a or c
gtgggaaaggttcagcgtttgcagatgatataggatgcttatgtcttcaggaagtgctttaatttcactgnatgagagatcaagatacctcaggtgatgat

SEQ ID NO: 51549 - DNA, 101 bp, rice(Oryza sativa)
  misc_feature (71): n=a or g
ggcaaactcctcaacacccggtgttgctactgagatgcaacaaactacgtacacaatatgacaatgccctngattggcagcgacctagcaacgggtggcag

SEQ ID NO: 51550 - DNA, 101 bp, rice(Oryza sativa)
  misc_feature (71): n=a or g
aagataaaggcaggattgcaggaaaaatatatggtcttgtagaccacagatcagaatcaagcgatgaacancaaatcttaaatgagtaaaaagcgccagat

SEQ ID NO: 51551 - DNA, 101 bp, rice(Oryza sativa)
  misc_feature (71): n=a or g
ttgacccgaatcgaatcgccgatgagatgttggcagcggaagggggaaggggatggatggagatggagatnggtcgcaaactcgcaacggaaagctgcgtg

SEQ ID NO: 51552 - DNA, 101 bp, rice(Oryza sativa)
  misc_feature (71): n=t or c
ttcctctacatcgactccctactctgcttcgtctacttccactacttcaacatatctattggtggaggcgntggtggaggtggcggcaaggacactggaga

SEQ ID NO: 51553 - DNA, 101 bp, rice(Oryza sativa)
  misc_feature (71): n=a or g
attagtgcacacagagtagaaaggtcccccttatgttcaatcagctcattgagatcaaagaccatagaagntttcatagaaactcccattctttccttaaa

SEQ ID NO: 51554 - DNA, 101 bp, rice(Oryza sativa)
  misc_feature (71): n=t or c
aacaagggatccaattttacttctagacacacgggaagtctataggatagaaacgacaataccgaatatantgtagaaacgacaaatggaacactaatatg

SEQ ID NO: 51555 - DNA, 101 bp, rice(Oryza sativa)
  misc_feature (71): n=t or c
aatccagcaatctacaaagagaacactattactttgtgctgagtggaagctccttcttaatgcaatggtangcagtcctcctgtgtattcgagtttttttt

SEQ ID NO: 51556 - DNA, 101 bp, rice(Oryza sativa)
  misc_feature (71): n=t or c
atattctcatgatcacttacattggtaccatcctcattcatgttgatttcttctgtagatatggggccctnatcttcaatgatcatgtcacttgcttcatc

SEQ ID NO: 51557 - DNA, 101 bp, rice(Oryza sativa)
  misc_feature (71): n=a or g
tggaattccacccaccgaaaacccgcatcagcagttaaaaatagtgatgcgggtttccaccacggaatcanaaagcgacggcgaagaagacgacgacatga

SEQ ID NO: 51558 - DNA, 101 bp, rice(Oryza sativa)
  misc_feature (71): n=a or g
gctcttccaccggtcgacgatcgatatatcttcatgcatgatcgattggtagtgctggcaagttattggcntgcgtgtgcagtcgacctgacaatgatgca

SEQ ID NO: 51559 - DNA, 101 bp, rice(Oryza sativa)
  misc_feature (71): n=a or c
tagaggcgaaagcaaaccagccagctttgcccgagaaaccaaagcttgcagagcatccatgactaagatanaaagcaacggcgatagagggtcgccttgtc

SEQ ID NO: 51560 - DNA, 101 bp, rice(Oryza sativa)
  misc_feature (71): n=a or g
tgggcgacgagggcgagaagaagaagcgagaagaagcggcggaagaaaagagaaggaagaagcagcggaanaaaagaggggtatttggggattttttatct

SEQ ID NO: 51561 - DNA, 101 bp, rice(Oryza sativa)
  misc_feature (71): n=a or g
agaaccatcaccttgttctccttgcaaactatctacagcaccttggtcacccgattgagccgtgtcatctngggcttgtttcacttcgccatctttggaag

SEQ ID NO: 51562 - DNA, 101 bp, rice(Oryza sativa)
  misc_feature (71): n=t or c
gagtctcggatatggcctccaaagtgtgaaggttggagcttcaccgaagtaacttgtcaagctcagcttcnagacaaaaatgcacaaccggtatcccaaat

SEQ ID NO: 51563 - DNA, 101 bp, rice(Oryza sativa)
  misc_feature (71): n=t or c
agttggatagcgcaaggcaaaggtataatggagttaagaatatttcttggaccacttcgggaccggatctnacattgcccatttcttgatgaggtggttcg

SEQ ID NO: 51564 - DNA, 101 bp, rice(Oryza sativa)
  misc_feature (71): n=a or g
aaaatttgtggctacgccactgccgagtacgatacttcctaattgcaacaaaaaaatttctggctacgccnctgccgagcacgacacttcctaattgcaac

SEQ ID NO: 51565 - DNA, 101 bp, rice(Oryza sativa)
  misc_feature (71): n=a or g
atccaagtagccaatcgttccttgaactgcagtagttattcctgtttcattgattgagatatatcttgaanctctaaagtcggatacctttgctgttaggt

SEQ ID NO: 51566 - DNA, 101 bp, rice(Oryza sativa)
  misc_feature (71): n=t or c
caccacgcacgccattgccagttctgcctctctcttcagtgtcactgatagataatcactcttgtcaatgncaggttgatgatgtgttcttccttccagag

SEQ ID NO: 51567 - DNA, 101 bp, rice(Oryza sativa)
  misc_feature (71): n=t or c
ggtttcgtgcagatgctgctcctcgacggatgctacatccttggcaagttcgtgctccatgacctcttacncgtcagggccaacggtgcggggacgagcca

SEQ ID NO: 51568 - DNA, 101 bp, rice(Oryza sativa)
  misc_feature (71): n=a or g
cggctgtggtggctcgcactcgactgctcatgaattggttgtttattgccggactgtatcatgggagaganttctatccaactgctgacatcaaagatata

SEQ ID NO: 51569 - DNA, 101 bp, rice(Oryza sativa)
  misc_feature (71): n=a or c
ctccatattgatggcggattaatgggaatggaagaacagataacgttaaattaaaggctaaactgacgtgntgtaaagcaacctgtcatattttgaccttt

SEQ ID NO: 51570 - DNA, 101 bp, rice(Oryza sativa)
  misc_feature (71): n=t or g
cgacgctggtgtttggcatctcgacaccggcgcgactaaccacatgactggcgtgcatgacatcttctccnagctcgacacggtggtgcgcggcaaggtct

SEQ ID NO: 51571 - DNA, 101 bp, rice(Oryza sativa)
  misc_feature (71): n=a or g
tttctcctgaagaactacctctcttggcttcgcatccccaaaaggattaaccttcggccgagccctcggcncaccttcactacccacagctgatgtctgtg

SEQ ID NO: 51572 - DNA, 101 bp, rice(Oryza sativa)
  misc_feature (71): n=t or c
gtgtgttttagccttttagaggaatttgcggatatatgagtgtggtgctatgtgtttagtggtgtgtttanatctgccgtgttataacaaaggaaaaatcg

SEQ ID NO: 51573 - DNA, 101 bp, rice(Oryza sativa)
  misc_feature (71): n=a or g
ataggtgggtcttttccgagtaagaagttctattacaagaactccaaagctaaaaacgtcacttttgtccnttaaatggcctgtataataatactcgggat

SEQ ID NO: 51574 - DNA, 101 bp, rice(Oryza sativa)
  misc_feature (71): n=t or c
gttgatgggataaaaaaggactgaagtttagatgcacacagccctactactcctatatcccatcgactgangactcgtcgacagtgacaattgttttggaa

SEQ ID NO: 51575 - DNA, 101 bp, rice(Oryza sativa)
  misc_feature (71): n=a or c
ttgacagcattgcattatctactgttttgtttgctggtgctgcaattatgggatacataatgtttggtgantcaacagaatctcagttcacattgaacttg

SEQ ID NO: 51576 - DNA, 101 bp, rice(Oryza sativa)
  misc_feature (71): n=a or g
tttctagaatacttctacgtggaatactcgttaaatgcgtattctctgtattatgctttggacaggactcnaacctccacaccttttagcacgagattttg

SEQ ID NO: 51577 - DNA, 101 bp, rice(Oryza sativa)
  misc_feature (71): n=a or g
gcgatagggtacgtggtactgatgtacagtaaccggagcactgcacgtttgtgtcatcgtgtgtgtgtgtnccactgactgtatgccaagaaggtatactg

SEQ ID NO: 51578 - DNA, 101 bp, rice(Oryza sativa)
  misc_feature (71): n=a or g
accatgactacaaatgataaagattgtgacaaggcacttcagaagctcaagcaagaagtttgtggaaagangtacctcctggtgcttgatgatgtgtggaa

SEQ ID NO: 51579 - DNA, 101 bp, rice(Oryza sativa)
  misc_feature (71): n=a or g
tcaacctgtccaggagaaaaggaaacaatgtgcacctcagccttcaaaacaaccactggctgccaatcctnaaccccattaccacgataagtgaaattgat

SEQ ID NO: 51580 - DNA, 101 bp, rice(Oryza sativa)
  misc_feature (71): n=t or g
acatgcttttgtttttggagaaggagaacacctgcaaggaaggcctcaccagtgccatgtaagttgtcctncttcaggatattttatctataatctaatta

SEQ ID NO: 51581 - DNA, 101 bp, rice(Oryza sativa)
  misc_feature (71): n=a or c
aaaattatataatggtgttgagctgccatgggtgaaactgatctcacagacttattatgtttctagagtancccatctggttttgaacaagggttctttct

SEQ ID NO: 51582 - DNA, 101 bp, rice(Oryza sativa)
  misc_feature (71): n=t or c
aagggacaaaaccgtgttaagatgaagttgaaccttgatgaccagttgtatccttaattgctacttccagnataacatcatgtgagagtatagtcgaatgc

SEQ ID NO: 51583 - DNA, 101 bp, rice(Oryza sativa)
  misc_feature (71): n=t or c
cttcaagaaggtcaggtgcttgcttcttcaacttagaagcaagtatcttcgatccttcttctgcaagtgcngatgaaatcttttgaacaactgctatgacc

SEQ ID NO: 51584 - DNA, 101 bp, rice(Oryza sativa)
  misc_feature (71): n=a or c
gagtccctagtgcaagcagaggccaatacaaatgaaactgagttgctagaaccagatatgaagagcaatgntgacctaaaggcaatacggattgtcaaatt

SEQ ID NO: 51585 - DNA, 101 bp, rice(Oryza sativa)
  misc_feature (71): n=a or g
gcatggtttcataactggagggagtatttaagctaaataatcatgtggattgggtcgcaccatgcttgacncggaacaagttgtagcagagaaaattgact

SEQ ID NO: 51586 - DNA, 101 bp, rice(Oryza sativa)
  misc_feature (71): n=t or c
ggtggagggctccggccggccgtagctcacacgccggcgatgtcaagtgcgaccactccaattgtatctgnggtggcggctgcctttttctttggttgggt

SEQ ID NO: 51587 - DNA, 101 bp, rice(Oryza sativa)
  misc_feature (71): n=t or c
cgacaatacatcaccaatggtcttcatcaacacgctgccgccgtatcgtccacaagcatggacacatgcgngtcctctgacagattaatctgcaagacgct

SEQ ID NO: 51588 - DNA, 101 bp, rice(Oryza sativa)
  misc_feature (71): n=a or g
ttactaggaagcaccacccaagctctcatggaatgcaaatccatatctgaatttgaggctagcaggcttcncttcagcaaaatacttagtcctcgaatagc

SEQ ID NO: 51589 - DNA, 101 bp, rice(Oryza sativa)
  misc_feature (71): n=a or g
aacagctggaaaccgaggccacgcagcgcctgctggtacatgttcaaaccgtcctggaacatggccaagcncggcatacatctccggggctctgaacacgc

SEQ ID NO: 51590 - DNA, 101 bp, rice(Oryza sativa)
  misc_feature (71): n=a or g
atcagtcacttggctaatcagctagccagacaccagtttctgaagattgcttgccagcttgaaaggaaaancatagctagcgcctattcactgcttagagt

SEQ ID NO: 51591 - DNA, 101 bp, rice(Oryza sativa)
  misc_feature (71): n=t or c
gcagacatcaggctcagtggactccttgaatccagcacaaatcgccttgagaaccgaagtgctctccaatntgcctgtaaaatcaacagcaaacaatctgt

SEQ ID NO: 51592 - DNA, 101 bp, rice(Oryza sativa)
  misc_feature (71): n=t or c
tcctcctctctccccatctcactctcttcatctccctatctctactctctctaggcgccacggaagacaanggcatgcggcggcgtgcggccggcgatagg

SEQ ID NO: 51593 - DNA, 101 bp, rice(Oryza sativa)
  misc_feature (71): n=t or c
gaaaaacctagtttaagtgataaataaccttcaaatgcgcctccattagtatcacaatcgttgttgcttcnatcatgtttcgaactgttgaaagttgaaac

SEQ ID NO: 51594 - DNA, 101 bp, rice(Oryza sativa)
  misc_feature (71): n=t or g
ctggtcccggtatcttcgttccccgcgcgtcgtaggtcttagcagcaaatttgacttcttcttcttctcgnatgtgatacttgcgtgcagcaaatttggct

SEQ ID NO: 51595 - DNA, 101 bp, rice(Oryza sativa)
  misc_feature (71): n=t or g
taggatatgagtttgcgcaccatcttttccatgaaacccggtagaagtaccctcaagaattgcggcttatntgacgcgtctcttgctctaccgcttctggt

SEQ ID NO: 51596 - DNA, 101 bp, rice(Oryza sativa)
  misc_feature (71): n=a or g
cggtagcggcggcggcggagacggtggcgggagcgggatgaagaacttcctccggaagctccacatcggcnactcggccggcgatggcgcctcgtcgctcg

SEQ ID NO: 51597 - DNA, 101 bp, rice(Oryza sativa)
  misc_feature (71): n=a or g
accatcttcaccgcttgtgaaaattaagtagctaggttaagctgaccaccaggaaaaattattttcgagcnaaaaaaaaaaacccaaatccgccacccacg

SEQ ID NO: 51598 - DNA, 101 bp, rice(Oryza sativa)
  misc_feature (71): n=a or g
cctccttattctcttctactacttaattatatcctggatactccctcaaaaaattataccctggataaatnattgcaaagaggccttatctgcccattgca

SEQ ID NO: 51599 - DNA, 101 bp, rice(Oryza sativa)
  misc_feature (71): n=t or c
atgttttgtcaagcactggctagattagtgacatcactgcacagttctagatgctcctcatttcctcttanatggctatcccttaccctgcgcaaatctgc

SEQ ID NO: 51600 - DNA, 101 bp, rice(Oryza sativa)
  misc_feature (71): n=t or c
tatgtgaccagtcagaccacctagctcgacggtctgactgtgtgaatacttgaactctactgtaatgcccngaatttcgaattactatatttcagggaata

SEQ ID NO: 51601 - DNA, 101 bp, rice(Oryza sativa)
  misc_feature (71): n=t or g
gagttaccgatcttacaacccatcaattgctctgcggtgggatcttgggactgtatgaccaagcatgtctncaagccttcacttgcataatactaaaacgt

SEQ ID NO: 51602 - DNA, 101 bp, rice(Oryza sativa)
  misc_feature (71): n=t or c
aattataatgcagaaattcagatggcatctcgattgtagctagactctgcctacccagatcaaactccagnatgccctcctcctcgccactgaacaaccag

SEQ ID NO: 51603 - DNA, 101 bp, rice(Oryza sativa)
  misc_feature (71): n=t or c
gatggtacatcaagaaggggagcacatgcgaggctgaaaggttcagaaaggagatggagaagatcttatgnagcggtagttcattggcagtgtgtcagtgg

SEQ ID NO: 51604 - DNA, 101 bp, rice(Oryza sativa)
  misc_feature (71): n=a or g
ttaggtttggtgttcgttggttcttgtaatgaagagattgcacagacaatcatatgtgtcttaatggagcntagtgagccagagcttgcagagccaattat

SEQ ID NO: 51605 - DNA, 101 bp, rice(Oryza sativa)
  misc_feature (71): n=a or g
gcggcgaaaatcgagaagggaaccgtacaggcgaaagtctcatggcgaaggccatggctcggacactcggncttcgccagacaaggacttcgtcagaaggc

SEQ ID NO: 51606 - DNA, 101 bp, rice(Oryza sativa)
  misc_feature (71): n=t or c
ctctgcttggggaagactctgcagaactttttgcaggctactttcaccatcaacaggagggagtttgctgntatcctcagcattggacttcgatccagatg

SEQ ID NO: 51607 - DNA, 101 bp, rice(Oryza sativa)
  misc_feature (71): n=t or c
tgcctctggaagcagttcctgtcgcattggagaactccttcatataacctggtgcgaattgtgttcatggnattctctagcattatcttcggtgtgctata

SEQ ID NO: 51608 - DNA, 101 bp, rice(Oryza sativa)
  misc_feature (71): n=t or c
acagccgccggtgagcccgaggctaagccctctcttcttcccacaccgtttcctctctcctcctcaactcncgcgtccgccatcttttaacagtgaaattt

SEQ ID NO: 51609 - DNA, 101 bp, rice(Oryza sativa)
  misc_feature (71): n=t or c
tttaatacttatatatttagtgtccaaacatccaatatccaacgtgacaagaaaactttagtcacgggatncaaacgcttagcacaacttgatatcctagg

SEQ ID NO: 51610 - DNA, 101 bp, rice(Oryza sativa)
  misc_feature (71): n=t or c
ctgagcatgttgcatggtacagaaaaggaaacataagcttaggaaaactgcaagtgcagaagaagatgagngaaacatgtatctttacttttacgagcccg

SEQ ID NO: 51611 - DNA, 101 bp, rice(Oryza sativa)
  misc_feature (71): n=a or c
gctctctgtgactatcttgaatgaccgtgcacttggattgagttgtccaccgcctggcactgccaccgtgnctggggcatcagcagtggggtccaaatgct

SEQ ID NO: 51612 - DNA, 101 bp, rice(Oryza sativa)
  misc_feature (71): n=a or c
tctccaagaaatctcagcatatctggatcttcataaggtaatgaaggcttcccagtccattctggaatatntgccagaccaaaagagcgatttgcacgaga

SEQ ID NO: 51613 - DNA, 101 bp, rice(Oryza sativa)
  misc_feature (71): n=t or c
tctgaagaggttgcagtaagcagcgaagaggttgtgattgtacagcgcaatgagatcagatcaagaggcgnagatccctccgtgtcaggcgggaaacagcc

SEQ ID NO: 51614 - DNA, 101 bp, rice(Oryza sativa)
  misc_feature (71): n=a or c
ttcaaacgcttgtgtcttgttacgcattgagcacgtgtctgctttgtcacgagtttatctccttccctctntagattgtcttgcagagatggcgtctacag

SEQ ID NO: 51615 - DNA, 101 bp, rice(Oryza sativa)
  misc_feature (71): n=a or g
aatgcctaatagaaacttctggagcagtatttgctgaaacagctgcctcatgtctactaattgtagactcntgtgggttaacagtggtagcaacttgagcc

SEQ ID NO: 51616 - DNA, 101 bp, rice(Oryza sativa)
  misc_feature (71): n=t or c
aaaaagtaacttctgaggcttcctgtgtagtcaggaaactgaaaataccttttagtgaatcagaacatcanagtatcaatcataatttttagatagcacac

SEQ ID NO: 51617 - DNA, 101 bp, rice(Oryza sativa)
  misc_feature (71): n=t or c
gaaacaaagtgcaaacttactgcaatcagcttcacattattgattgactcacccaagttgctccagagggnattgaacatatcagttcccctacagtagca

SEQ ID NO: 51618 - DNA, 101 bp, rice(Oryza sativa)
  misc_feature (71): n=t or c
ctatttttcatgtaaatctgggataaccattcaataagtttctgtacttttctgggattagccacacacanacacacaccccatcattcttcaggactgaa

SEQ ID NO: 51619 - DNA, 101 bp, rice(Oryza sativa)
  misc_feature (71): n=t or c
aaagcgggacgggtggtctagtggtcacagcttggcgtctttaacgccactgattgaggcgggggaggtgnggaaggtgctggacaggcggccggcagcgg

SEQ ID NO: 51620 - DNA, 101 bp, rice(Oryza sativa)
  misc_feature (71): n=t or c
accgttctcggtgagatcagagatagcattagattccccttatcggcctttgtaggcactatattgggttngtctaggtcccaatgtcgaccgagaaggta

SEQ ID NO: 51621 - DNA, 101 bp, rice(Oryza sativa)
  misc_feature (71): n=a or g
cagttacataatgtatagtggtggtaccagcccattgtatcgcttacagttatgcttatctatacggcttnttaataattaaaaaataatttgtatgtaaa

SEQ ID NO: 51622 - DNA, 101 bp, rice(Oryza sativa)
  misc_feature (71): n=t or c
agatgaattcaggaacaaaagctaatactgacgtgtttttgggtcaaaggcaaatacatgtgtaaatgggncaacggttaatactcataaatttattgggt

SEQ ID NO: 51623 - DNA, 101 bp, rice(Oryza sativa)
  misc_feature (71): n=t or c
acgaacttttgtgtattcaatctaaaaactcaaagccaagtattagtgactacattaagtaaattaagganagattgatcatgatgatatttaatttgttt

SEQ ID NO: 51624 - DNA, 101 bp, rice(Oryza sativa)
  misc_feature (71): n=t or g
tctcatcaaaggtaacatccctggaattgtaaacccgacctaaagcaacatcgagacacttgaaacctttntgcattgtgctataaccaagaaacatgcat

SEQ ID NO: 51625 - DNA, 101 bp, rice(Oryza sativa)
  misc_feature (71): n=t or c
caacacgtacggtactgtttgtactactaagatcatcacgtacgttacgactgaatcaaattaacgcgcancgttgagtgagagaaatataacatgctaca

SEQ ID NO: 51626 - DNA, 101 bp, rice(Oryza sativa)
  misc_feature (71): n=t or c
tggcacagtgttatttgtggttaattaacgtgatggagtttggaatttgatggggtttgtgatgtgcaggnggcgatcaggacgatcaagaaggcggccgt

SEQ ID NO: 51627 - DNA, 101 bp, rice(Oryza sativa)
  misc_feature (71): n=t or c
atataaatgatttttctgcagtaaatccatcccctataggttgtagacataccgtgattggtcacgtctgnaaaaatcaatctctattttcgcgaatggct

SEQ ID NO: 51628 - DNA, 101 bp, rice(Oryza sativa)
  misc_feature (71): n=t or c
ataccgtcggccatgacgagggatataggcgaaaacattgccagaatgtcggcaaagttctttgtactcantgggattgaatccgcaatgtcccggcgaag

SEQ ID NO: 51629 - DNA, 101 bp, rice(Oryza sativa)
  misc_feature (71): n=t or c
tgcacgcggagaagggtgacgagttgacaacacaagaaataataattttgattttaatactacctccatcncaaaataagtgcagccgtagaaatccgtgt

SEQ ID NO: 51630 - DNA, 101 bp, rice(Oryza sativa)
  misc_feature (71): n=a or g
tagcagtagcacccggtccggacatccagatctcagccaagaggtccttgttcctgtacttgtgtgggacnctcgcccagatcacatgatcaaaccttgct

SEQ ID NO: 51631 - DNA, 101 bp, rice(Oryza sativa)
  misc_feature (71): n=a or g
ataaattaactcctatcaatttggacacaagcatgcccccactgcattttggcaagaaaaatgcggtcacncttatttgattattctacctatttataatg

SEQ ID NO: 51632 - DNA, 101 bp, rice(Oryza sativa)
  misc_feature (71): n=t or c
gtgatgaattggttgcccgacgaggtgaatctgtgatgattcggatgtgaatccgtgggtggtttttttgntttttttccatcgctattgctaaccaaatc

SEQ ID NO: 51633 - DNA, 101 bp, rice(Oryza sativa)
  misc_feature (71): n=a or g
gattacccgctggcccaggaggtttcggagtatagatcgcgtctgctgcacaaaatccatctctcctactncaaggcgctggagcggctcagcctcagggt

SEQ ID NO: 51634 - DNA, 101 bp, rice(Oryza sativa)
  misc_feature (71): n=t or c
gattgaatttcttgaagcctagtcctgattgacccacagtcgaccaccaagttatccaatgatgatgcctntagccgatgagagatatcttcaagagtccg

SEQ ID NO: 51635 - DNA, 101 bp, rice(Oryza sativa)
  misc_feature (71): n=t or c
gtttgtctatcttggacctgcttgcccttgcatgcatgcagccactaagaatccaactcattgtttcttgngttgtgcatgtcattaaataaaaagaaaaa

SEQ ID NO: 51636 - DNA, 101 bp, rice(Oryza sativa)
  misc_feature (71): n=t or c
ttcctcctcagcgatgacaacgttgatcttgctactgtagttgccttcttctttgctaacctcaacaattntggtggccccatgacctcaccgacctccac

SEQ ID NO: 51637 - DNA, 101 bp, rice(Oryza sativa)
  misc_feature (71): n=a or g
tggttgccttccatttaggtgggattgtggcatgttcatgctcaaatacatagatttctacagcagagatntgggccttacttttggacaggtaccaaatt

SEQ ID NO: 51638 - DNA, 101 bp, rice(Oryza sativa)
  misc_feature (71): n=t or c
ggattgttcttttctttaaatgttcatagttctagattgtttcaccttgacctgtgttctacccctccccnctttcctcttctttcgttgaggtaagtgta

SEQ ID NO: 51639 - DNA, 101 bp, rice(Oryza sativa)
  misc_feature (71): n=a or g
tccagctcggatgccctcgccgccatcgccgcgtgctcagcacagttgctttccagatggatggcctcacncccagcaacggcctcctcacgcttggtgag

SEQ ID NO: 51640 - DNA, 101 bp, rice(Oryza sativa)
  misc_feature (71): n=a or g
gggaaggaaaggagaggagggataagggttttgcggttttggttgagagctttttccgccttcgccggccncagtgacaccgctagttttccgccttggcc

SEQ ID NO: 51641 - DNA, 101 bp, rice(Oryza sativa)
  misc_feature (71): n=t or c
accacgccgctacgagcgacgagctgcaaacttctagcgcttggacttggcgcgatctgtgccgcctccangcctctacccatcgagcgcacgaaatgggc

SEQ ID NO: 51642 - DNA, 101 bp, rice(Oryza sativa)
  misc_feature (71): n=a or g
aaggctatatgagagatattggaagaacaaaatttatcgatttatagactcatgatagataggaaggtagnaattagtttattttagaatggacagctata

SEQ ID NO: 51643 - DNA, 101 bp, rice(Oryza sativa)
  misc_feature (71): n=a or g
cgaggcctatccgatccggccgtgcaggtgatgcagtggattcactgcagagaaaggaagagaagagaganagagagagagagagaggcagctagcacatg

SEQ ID NO: 51644 - DNA, 101 bp, rice(Oryza sativa)
  misc_feature (71): n=t or c
agtgggttgtggtgttttggcagcaggcaacgcgccccaaaatcatagaaccaaacaaaaactcaaatatnagggaaggacctattatcaaataattagaa

SEQ ID NO: 51645 - DNA, 101 bp, rice(Oryza sativa)
  misc_feature (71): n=t or c
tcatcattcatcacaatcgaatgatctagaaaatatctgtgatcagactataacaattgccaaatactccntccttattttaatatatgacgccgttgact

SEQ ID NO: 51646 - DNA, 101 bp, rice(Oryza sativa)
  misc_feature (71): n=t or c
ttgataattcaaattgccccctagtaattctgaaggtttggctgaatactacgtaccagatgctcaggaanaacttgaggcatcactgtgccatctggctg

SEQ ID NO: 51647 - DNA, 101 bp, rice(Oryza sativa)
  misc_feature (71): n=t or c
tgttttagttatgtaaacaagcagctggtctgatacatgcgtgatgtggagactggataaaattacaatancaaaataaatgtaatcctttatatttatat

SEQ ID NO: 51648 - DNA, 101 bp, rice(Oryza sativa)
  misc_feature (71): n=a or g
ttagatactccaaaatgagtatgtcactaccagctgagaccggaaggctcccatgtaaaacaaaaaaaagnaatggcttaaaaacacacgaaaacgtcatg

SEQ ID NO: 51649 - DNA, 101 bp, rice(Oryza sativa)
  misc_feature (71): n=t or c
tttttttcaggaagtgagatcatgggagaatactaggagcggtttccggatctagaaacacctcccctaanactttcattactcatcagaaaaatctattg

SEQ ID NO: 51650 - DNA, 101 bp, rice(Oryza sativa)
  misc_feature (71): n=a or g
tcttcacaggtcttgggcaggaaatattttagactctattctgcttccatctccaatgacctttaccctcncagagaaactatgctaagcaatattagtca

SEQ ID NO: 51651 - DNA, 101 bp, rice(Oryza sativa)
  misc_feature (71): n=t or c
atattgtctttttaagttttgcgtcaaatgcctgcatatctgtatccagtcatatacataatctttggtgntagattgaaggttgctagcacttttgctca

SEQ ID NO: 51652 - DNA, 101 bp, rice(Oryza sativa)
  misc_feature (71): n=a or g
tgcaacgcctcttttccatactgataaaagcaattgatgagtgcatttgaacagactaggaacttttgcgnaaaccacaattttttgtttgctcactgtat

SEQ ID NO: 51653 - DNA, 101 bp, rice(Oryza sativa)
  misc_feature (71): n=t or c
gtagggctccttccagtaaacatctcaagcaacaatatgcctaagctgtaagtatcgcctgctctggttantgtagacccttccccatactctgcaatgtt

SEQ ID NO: 51654 - DNA, 101 bp, rice(Oryza sativa)
  misc_feature (71): n=t or c
agaagacggccacgacgacgcaaacatgcaaaattgcagcggagaaggagaaccataatctttctcaggangcaggcatctcaatccgtcagcttgcacgg

SEQ ID NO: 51655 - DNA, 101 bp, rice(Oryza sativa)
  misc_feature (71): n=a or g
tggcagctcagcttgcagagttgctgttgagcttggtccatttgtcgagtttactgacaacggtaggccanaatttcatgtcactaagaaaattaactggg

SEQ ID NO: 51656 - DNA, 101 bp, rice(Oryza sativa)
  misc_feature (71): n=a or g
tctttccttcagatcctccacttcgtcatcaacttcgcttccccatctttatatgccgtcgtattccatcngcaccgcatgagagctacgtgcgaaccgcc

SEQ ID NO: 51657 - DNA, 101 bp, rice(Oryza sativa)
  misc_feature (71): n=t or g
tgcagaacaaggcaccaaggacaatggatgcgctctttgcacaaatgaagcagcagaggatgaggaccatnccacagcagcagacgaatactgcccctggc

SEQ ID NO: 51658 - DNA, 101 bp, rice(Oryza sativa)
  misc_feature (71): n=t or c
ccaaatgtagagtcactaagaggatttgggcagaaatccaaagatggacacatactgacctccaaatgganaaatggaatgactgcccctcgattgaacat

SEQ ID NO: 51659 - DNA, 101 bp, rice(Oryza sativa)
  misc_feature (71): n=a or g
gcttgctttttcatgtcttaattccacgttcttccgcctgcctttcctatattatattggcagggcgttcnccggaagttgtgtgttcggcctccctttgg

SEQ ID NO: 51660 - DNA, 101 bp, rice(Oryza sativa)
  misc_feature (71): n=a or g
ttagaaagtcttataatatgaaacggaggaagtagacaacaaacagaagcggatttgtggtaattacctcntgtttgaccacaatatataaaaacaaaata

SEQ ID NO: 51661 - DNA, 101 bp, rice(Oryza sativa)
  misc_feature (71): n=t or c
aatacacgcgcagcgcgcggcaaattagcgtggcaaataagcagaaacgaaaacttttggcggaaaaacgngcgcataagcacagattgaataaaattggc

SEQ ID NO: 51662 - DNA, 101 bp, rice(Oryza sativa)
  misc_feature (71): n=a or g
ttgaccccagagcgctgaggagggacgttgtttccatcaagagggcaccgcctaacaggacataggtaacngcggtgtcgactccattctggccatccttg

SEQ ID NO: 51663 - DNA, 101 bp, rice(Oryza sativa)
  misc_feature (71): n=a or c
tgtggtatgtcaagaccccttgctgcaacatcagtgcaaactagaataccacttgagagagctgaaaatgntgccaaagctttctcacgagggccctacat

SEQ ID NO: 51664 - DNA, 101 bp, rice(Oryza sativa)
  misc_feature (71): n=a or g
tgcactcccaagaccggtttgcaagcacacctgcaaaactgaacctctcccatctccagatgtactgaccnatttttgcagagaatgcttgtgtaattttg

SEQ ID NO: 51665 - DNA, 101 bp, rice(Oryza sativa)
  misc_feature (71): n=a or g
gtgctagcacacgtagaactcgaaagctaataagtgagggcatcacactaatagaacactccatggcattnaatgacctcagtcgtgtcatgccggcgtct

SEQ ID NO: 51666 - DNA, 101 bp, rice(Oryza sativa)
  misc_feature (71): n=t or g
cctttgccaaaggcaaaaaggggaaagtacgagccgaacagccgtaacacacaccacaacccttttatttnccaaaaagcacaagttacagataaattcca

SEQ ID NO: 51667 - DNA, 101 bp, rice(Oryza sativa)
  misc_feature (71): n=t or g
cggcgactccgaggcggaatcattcccgttctcttcctacacctccgatgctgcggtttggattctctganatgctagcgctagcgcccggatgtccaggc

SEQ ID NO: 51668 - DNA, 101 bp, rice(Oryza sativa)
  misc_feature (71): n=a or g
acacacagagagagacacacatacataagtttctaattttgggggggaaattagcccatctatcacttttnaaaaagtagatacttttcaaagatattgta

SEQ ID NO: 51669 - DNA, 101 bp, rice(Oryza sativa)
  misc_feature (71): n=t or c
acataacattccatcgccggtttacaagacaaagcaaatgcatcaaagcgaaggagagaacaaaccactangcagttgcgccaaaccatcacatctcctac

SEQ ID NO: 51670 - DNA, 101 bp, rice(Oryza sativa)
  misc_feature (71): n=t or c
caaggaaggtgatgctagcaacgtccttgcctatacaagtaatttgctttacaagataaaggctcacccanagctctttgactcctttgacttcatctttg

SEQ ID NO: 51671 - DNA, 101 bp, rice(Oryza sativa)
  misc_feature (71): n=t or c
acttaggtggccaccttgctcatgcaatttgatgagcacatcgaccaagttttcctcgttgtcctccatgnccaatctgcccttgcattctcttgcagcgc

SEQ ID NO: 51672 - DNA, 101 bp, rice(Oryza sativa)
  misc_feature (71): n=t or c
acaactatttttagatgtttcataatacaaaacgtacatatatgcatgtaattaactaaaatcttctgagnaaaggctgagatgtttcattccattattaa

SEQ ID NO: 51673 - DNA, 101 bp, rice(Oryza sativa)
  misc_feature (71): n=t or c
agtatgcatgttgcagcaagcttaccacatcagaattgcccaaaaatgtaggaaaagaatagaacagtganaaccaatgtgtgaaagtaacagtttagtca

SEQ ID NO: 51674 - DNA, 101 bp, rice(Oryza sativa)
  misc_feature (71): n=a or g
ataggagaaggcatgccgttgggagcgctatatatgcatgggatcttattggtatctagcattcccggccntatattatacgaaaatcctgttgggcgatc

SEQ ID NO: 51675 - DNA, 101 bp, rice(Oryza sativa)
  misc_feature (71): n=a or g
tcttctccacataattttacagttggcttatagctacgctactatatactcctttcatcttattttaagtncagtcgtgggttttcatgtctaacgtttga

SEQ ID NO: 51676 - DNA, 101 bp, rice(Oryza sativa)
  misc_feature (71): n=a or g
aaagagttggatcggagtgctccaatctaacacagctcagccttcagagattaagaccacagcacattctntaagagactaagaacagctcatacaaaagc

SEQ ID NO: 51677 - DNA, 101 bp, rice(Oryza sativa)
  misc_feature (71): n=a or g
acgattcagtccaagcattccacgccttgctacctcctcatttgataaaactgtcagggtctgggatgctnacaatgtaagtacataactgtttagttctt

SEQ ID NO: 51678 - DNA, 101 bp, rice(Oryza sativa)
  misc_feature (71): n=a or g
gtggatcccatggccaaccttgagttcttgtgatcttctctttcttgggcttttggtggatgaagcatccnccatgctccgtagatctggaaatagagagg

SEQ ID NO: 51679 - DNA, 101 bp, rice(Oryza sativa)
  misc_feature (71): n=a or g
cctttacttcatcctccctcctccgttaccttttcttcttcctcatcggcaccactatgagcttgagcgcncctgtctcctcctccttccccatgggtggc

SEQ ID NO: 51680 - DNA, 101 bp, rice(Oryza sativa)
  misc_feature (71): n=t or c
gtgcaatcatggtcgatgttcttcgcatgagggagttgctaatcttgcttttgttcttttgctagtgtacntgcaactctttctctgcaatcataggaagc

SEQ ID NO: 51681 - DNA, 101 bp, rice(Oryza sativa)
  misc_feature (71): n=t or g
gtggtgtaataatgctgtatgttgtctccatttgttttttccatggaaagcccaggattttgattatgatnactgatggcaccatgtctcaggctgaattt

SEQ ID NO: 51682 - DNA, 101 bp, rice(Oryza sativa)
  misc_feature (71): n=a or g
gtgaaaatccattttcgcaaacgaacctcttaagagatccgtctacgaaaataggtttatttttgttagcngtcctattacgagatccgcatataaaaaat

SEQ ID NO: 51683 - DNA, 101 bp, rice(Oryza sativa)
  misc_feature (71): n=t or c
cttgttaacccaaccaacaggaatagactacattttgaacagcttcttgtgaactttcaacaccagccganacgttagcgagactctcctcgcagtcctac

SEQ ID NO: 51684 - DNA, 101 bp, rice(Oryza sativa)
  misc_feature (71): n=t or c
ggatagaaaatgctgataattttgacgtgaacgaggggaaataactctggggagttttgaacttcaatctnctttcttttctcttttttttttcatattcc

SEQ ID NO: 51685 - DNA, 101 bp, rice(Oryza sativa)
  misc_feature (71): n=a or g
ctatgggacctaaattgcacggtttcgtatagtttaatggtagagatttctggtatcgaggataagagatntcaaataaactcggtgtaaagttgaggaat

SEQ ID NO: 51686 - DNA, 101 bp, rice(Oryza sativa)
  misc_feature (71): n=t or c
tcatatatagctgacacatctcccttctcatcatcaataggtcacacaagccaacttgtgataacctttcntaaagagatttgctccagtccaacaaaaag

SEQ ID NO: 51687 - DNA, 101 bp, rice(Oryza sativa)
  misc_feature (71): n=a or g
actgtcggcggtggagtggctgggtttgctctacaaggcggaagagctggaggtgctatcggcggcgaccnaccacgggacacccggcgcgctgctcggcg

SEQ ID NO: 51688 - DNA, 101 bp, rice(Oryza sativa)
  misc_feature (71): n=t or c
tccctagcctcaccagcaagctagaagatcacgtcaatggtgctggcgagccctgccaaactgggatcctnccccttacaactcctcgccttcctccctaa

SEQ ID NO: 51689 - DNA, 101 bp, rice(Oryza sativa)
  misc_feature (71): n=t or g
acacggtgaattcaatgggccacgtgagagcgtagaaactgggtagataacctgtgagagttttttttttngaaaaagtccaatttgactcccttaattgt

SEQ ID NO: 51690 - DNA, 101 bp, rice(Oryza sativa)
  misc_feature (71): n=a or g
aaatgaccttatacaaatatttcccaagaaatgaaatccttcagattttcttttagggcccctttgaaacncaggataggaaaaacacaggaataggaaaa

SEQ ID NO: 51691 - DNA, 101 bp, rice(Oryza sativa)
  misc_feature (71): n=a or g
ggacacggtcagatgcaatcctctgccttattctctccacttgctcgcattctttcaaaagcaaggtctcnacttcggcaaactgcttcagcttcagttcc

SEQ ID NO: 51692 - DNA, 101 bp, rice(Oryza sativa)
  misc_feature (71): n=t or c
tgcccgtttctctgcaatgaaaggattgctcgcgctcagcgaagatgggctgcttgtcctaccagtcgcangctcgaggacatcggcgacaacggcgaggg

SEQ ID NO: 51693 - DNA, 101 bp, rice(Oryza sativa)
  misc_feature (71): n=t or c
tttataatgccatactaataggacaaattaaaaatcggttcttagaaaaccactaccggttcactggttcnataaaaccgtccggttcatcggtttttaat

SEQ ID NO: 51694 - DNA, 101 bp, rice(Oryza sativa)
  misc_feature (71): n=t or c
tcgtctcgtggcgaagggatatgtgcagcaagccaacgtcgactttgaggaggtgttcacgctggtggcgnggctggagtccatccggctactggtcgccc

SEQ ID NO: 51695 - DNA, 101 bp, rice(Oryza sativa)
  misc_feature (71): n=a or g
agctcctcctccaccaccaccaaggccatccagatccggaaactctatcttactttggggctcttgctcgnggatgatttgaccgccatgtcttcgattcg

SEQ ID NO: 51696 - DNA, 101 bp, rice(Oryza sativa)
  misc_feature (71): n=a or g
gtaccgtgagattctggtacctcgaggtacttttttttttttaccggaactactcatctggataacatgcntatcctcaggattggatttttttttatgga

SEQ ID NO: 51697 - DNA, 101 bp, rice(Oryza sativa)
  misc_feature (71): n=a or g
tctagctcctttagcttataaagatcagagaatatgttacttagagaaaatcaacaccaagctagagaggnaaagaagatcagagaatatggctgcttggt

SEQ ID NO: 51698 - DNA, 101 bp, rice(Oryza sativa)
  misc_feature (71): n=t or c
gtggaagacgacggcgaggaggaagacgagaagtgcgggacacttcggagcagcgagggagtgggactccnccctccgtctctcttgggagtgtttgttat

SEQ ID NO: 51699 - DNA, 101 bp, rice(Oryza sativa)
  misc_feature (71): n=t or c
tgtctctcggtgaaaaaatttatggttgaaaaacttcttatgcataacaattgtcaatacaaaaggtccanacacatagaaattgtgtcgtatatatgtac

SEQ ID NO: 51700 - DNA, 101 bp, rice(Oryza sativa)
  misc_feature (71): n=a or g
ctcctcgtcaacttcggcttccctctcctcttcgtcgcctcgctcctgtggcggtcgccgaccatgaacanccccggcggcgggcctagcctcccgttcgg

SEQ ID NO: 51701 - DNA, 101 bp, rice(Oryza sativa)
  misc_feature (71): n=t or c
ctacgcatacggtacaacgatcaatatatttgcgtaacgacggcgccggccggccgctcagagcgtggcanggtcgtggcactcctggctgcgtatcccca

SEQ ID NO: 51702 - DNA, 101 bp, rice(Oryza sativa)
  misc_feature (71): n=a or g
atccccttcaccgaaaaatcagataggataatgcttgatccattagtgtgtatttcgtgcataagagagantattaggaagaacactggcgctgattattg

SEQ ID NO: 51703 - DNA, 101 bp, rice(Oryza sativa)
  misc_feature (71): n=a or g
aatcaaatatttttctctttatggctccaaaggagaaatgcaccactgcctttatattagagatggcaacngttaattcaccgtcgggggtcatctccgcg

SEQ ID NO: 51704 - DNA, 101 bp, rice(Oryza sativa)
  misc_feature (71): n=a or g
aaggattgctggcaattctcgattgttacgaagcatgtgtgccacttataaggagtggagaagtactaccntaatattacatcagcatccatagcagctga

SEQ ID NO: 51705 - DNA, 101 bp, rice(Oryza sativa)
  misc_feature (71): n=t or c
tcccttgacaacagcatcaacttgtggcttccaacttgacatggtttgatccattcggcgaacgatgactngagtctcgtcctgctttgccgccatcgctc

SEQ ID NO: 51706 - DNA, 101 bp, rice(Oryza sativa)
  misc_feature (71): n=a or c
aacccaagcatgtccccagctgccatctgccacgtccacatatgaggtgaaagaatgaagttacggtctanttgtcctactaaggctccacataaaggcag

SEQ ID NO: 51707 - DNA, 101 bp, rice(Oryza sativa)
  misc_feature (71): n=t or c
atatttcattgatgtaattgttgatgatggaagggaatggagacttactggaatttatggtgagtcgcgtngggagcacaaaggcaaaacatgggaggcct

SEQ ID NO: 51708 - DNA, 101 bp, rice(Oryza sativa)
  misc_feature (71): n=a or c
ccggggggtcacgagacagatctgccacctccatggctccatctgcaacgaaaatactacacagaaaaggntgcgacgaactagagcatcggcggagaaac

SEQ ID NO: 51709 - DNA, 101 bp, rice(Oryza sativa)
  misc_feature (71): n=a or g
gcagttgcgtcgccccccatgttttcgtagacctttatgtgtgctagctgtgcgtatatatgcgtttcttncgccaaacgagacgtacgagagcttttgcg

SEQ ID NO: 51710 - DNA, 101 bp, rice(Oryza sativa)
  misc_feature (71): n=a or c
tgctcatcgtaaggcattgaatcaaacagggttctggaaatgtctcttagcccagagctggaatcatcaancattctagctatgtcactgtgagaaaatgt

SEQ ID NO: 51711 - DNA, 101 bp, rice(Oryza sativa)
  misc_feature (71): n=t or c
aagaaatgtgatggccagccacttgctcttgttaccataggtgaattcctgcaagctaatggctggccaanggggcctaactgtgaagatctctgcaatcg

SEQ ID NO: 51712 - DNA, 101 bp, rice(Oryza sativa)
  misc_feature (71): n=a or g
ggctgatggtggtgagcgggaaagtggctaggacgctaacattaacggtttgtcttctcgatgattggccnagcaatctcctctccgtggggctcctcctc

SEQ ID NO: 51713 - DNA, 101 bp, rice(Oryza sativa)
  misc_feature (71): n=a or g
gcacgtgaaagtacagacgtaccctctcacccacgataccgcttcaatgaggtacggacgatttttgaccnttggatgatgctagatcaacggtcacgatt

SEQ ID NO: 51714 - DNA, 101 bp, rice(Oryza sativa)
  misc_feature (71): n=a or c
atttgtacaaataacagtatttgtactctgcttgtacgtatttgtgttattgcccagacagcctgaaatgntccgaacacacaaggcccttgattagtgcc

SEQ ID NO: 51715 - DNA, 101 bp, rice(Oryza sativa)
  misc_feature (71): n=a or g
gaggagcatgagctcaacccgaatggcccacccagcgtggatacaactgcccagaaacgaagagggagaangaccccagatccagccaccctgaagcagtg

SEQ ID NO: 51716 - DNA, 101 bp, rice(Oryza sativa)
  misc_feature (71): n=t or g
tatggagcatttggcagggttaatcagttgtccagtggctaaagcataacaggctagaacctccttaatcncccgtgcctgctgaatttcttccctgaaat

SEQ ID NO: 51717 - DNA, 101 bp, rice(Oryza sativa)
  misc_feature (71): n=a or c
cgccgaccagcaccgcaacgccccatccctggattcaggtttcagattgccactcttagttttcaggatanagtttacagcagaactggaggcattgctga

SEQ ID NO: 51718 - DNA, 101 bp, rice(Oryza sativa)
  misc_feature (71): n=a or g
gatttattccctatcccaaagcttatctggccatttcttctttgcaaggccaaaggaataagttcactcangtccctctatttgtcgtccagtccgatttt

SEQ ID NO: 51719 - DNA, 101 bp, rice(Oryza sativa)
  misc_feature (71): n=a or g
gatacgtcgacaacagtgcagagccgagcaatgccgcgggacatattcaggcttaggcagatccagagganccgcgggttgggcccttcccagtcaggatc

SEQ ID NO: 51720 - DNA, 101 bp, rice(Oryza sativa)
  misc_feature (71): n=t or c
aggctcaaacgtaccagctccggtggcatcccaagtgacggtggtggttcatgtaacagtgactcgatganggaatgcacatcctctcgggagaatctgcg

SEQ ID NO: 51721 - DNA, 101 bp, rice(Oryza sativa)
  misc_feature (71): n=t or c
gggagagagcctaatcatacgcttgttagaatttttatacggaggtaaagcaggtgtttcacaagatccangagcacagaaaagaataacatatatatata

SEQ ID NO: 51722 - DNA, 101 bp, rice(Oryza sativa)
  misc_feature (71): n=t or c
ctgaagaaaacaaaaaggtttttatacagaaacaacaaacgggaactaaacagaaatctaactagactagnaggatcggctggggattccagcttgccaat

SEQ ID NO: 51723 - DNA, 101 bp, rice(Oryza sativa)
  misc_feature (71): n=t or c
gcctatcgcttggtgttaccctcctccagccttattcatctagtggtgcacgtatcccaattgaagcaagntttggcaccaagtgaaacagcgtctcccag

SEQ ID NO: 51724 - DNA, 101 bp, rice(Oryza sativa)
  misc_feature (71): n=a or g
tttatggttagtaacgttttgtaggtttcgcctcttgtgagcggcgaaaccgtttttattattttttcctnggccgaaatgaacagtgatgggctttccct

SEQ ID NO: 51725 - DNA, 101 bp, rice(Oryza sativa)
  misc_feature (71): n=t or c
cattttcctcgagccttgctgcacgcattccttcctcaacaagttgaatctcctcctcgtccatctccatntcaacatccttcgctggctcggccaattcc

SEQ ID NO: 51726 - DNA, 101 bp, rice(Oryza sativa)
  misc_feature (71): n=a or g
acttttcttcaggtaaaacctatcgggtgctctcactacttctaaaactgtttttactgtcggccaaaatnggttttcgctagtggccggctataccgcca

SEQ ID NO: 51727 - DNA, 101 bp, rice(Oryza sativa)
  misc_feature (71): n=t or c
acaccctaatatcaatgcgaacattaatttccccatgctttcgtgtgagggaacgagatcatgtgatcatngggcagtgcaggtaaaagaaagctagtgca

SEQ ID NO: 51728 - DNA, 101 bp, rice(Oryza sativa)
  misc_feature (71): n=t or c
tttggcacataggaataaaatagggaaaattgacaaagtttagaagtttgtcggttttcctctgattgggntggtctgaccgctggttgtcggccggtcag

SEQ ID NO: 51729 - DNA, 101 bp, rice(Oryza sativa)
  misc_feature (71): n=t or g
ggaaccatcacaaggctgtcaggcacatcgacacagtgcgagcatatacattcggctcccactactttgtngaggtggatattgttctgccatgtgacatg

SEQ ID NO: 51730 - DNA, 101 bp, rice(Oryza sativa)
  misc_feature (71): n=t or c
taggattgtgattaggcctccggattaattagagttgatgcctaccaggaaaggaaaacgcatggatgggntgggccgtgagagcgatccagtagcccaat

SEQ ID NO: 51731 - DNA, 101 bp, rice(Oryza sativa)
  misc_feature (71): n=t or c
tggactcaaacatgtgctaggctgctagctagcatgggagagagcaaggaatgcagatatatatagcatgngaatttcgtctacagaatgggttcttttat

SEQ ID NO: 51732 - DNA, 101 bp, rice(Oryza sativa)
  misc_feature (71): n=t or g
ttattgctgggtggagcattgtaacgtccgctgagactgggcctactttccaggtatttttgaattacttncttttagaacaacccagtctcaaatattga

SEQ ID NO: 51733 - DNA, 101 bp, rice(Oryza sativa)
  misc_feature (71): n=t or c
gccaaaccctggacaaatttaccaattaagccttcatcttgacttaacgggaatttccaaattttgctatnaacatatctcgtgagactgcaccacccctt

SEQ ID NO: 51734 - DNA, 101 bp, rice(Oryza sativa)
  misc_feature (71): n=a or g
cgacttaccgtaagtttcacttattacgctcagtgttccctttctcctcgggcctttaaagtttctgaaangaagaaaaaaagttacatataagataattt

SEQ ID NO: 51735 - DNA, 101 bp, rice(Oryza sativa)
  misc_feature (71): n=a or g
atccaatatgatatgtttttacttcgaattaaaaatggtctaattaggggttctcgagatgtgaacctgcngtgctatccttatcctctgtcccaaataat

SEQ ID NO: 51736 - DNA, 101 bp, rice(Oryza sativa)
  misc_feature (71): n=a or g
gtcatcaccgtaattgtagttgtagtcgatagatccatccgtcccgttgtcattggggacagatctggacnccgcaaggtcgctagtggtggatccgcccg

SEQ ID NO: 51737 - DNA, 101 bp, rice(Oryza sativa)
  misc_feature (71): n=t or g
ttattcagatgttatgggtgtcattactgacatatctacacccacaatgcttcgtcctagatcaagggatnctgacagcttgaaaagaactattcagatac

SEQ ID NO: 51738 - DNA, 101 bp, rice(Oryza sativa)
  misc_feature (71): n=a or g
gctacgaacgctgttaattgttgcaggtaagaggtcgaagccagcgctatcgtgggagaagaggtacacgncagcgatcggtgtcgccgaggccctgagct

SEQ ID NO: 51739 - DNA, 101 bp, rice(Oryza sativa)
  misc_feature (71): n=t or c
cgccatgtagctgtcgcgacaacaccgcaggcggcgatcgtagcagcccttcaccaccagatagacgaacngcctcattgcttgcgtcccacccgcagcca

SEQ ID NO: 51740 - DNA, 101 bp, rice(Oryza sativa)
  misc_feature (71): n=t or g
ctccggcggggtagggagaacaaattttgtgccaagtgtggtaggaaggatgcacagatgtaatatcttgnttagttggggaaattttttaggtttgtttg

SEQ ID NO: 51741 - DNA, 101 bp, rice(Oryza sativa)
  misc_feature (71): n=a or g
agtttctaccacaaagatgtagaaaaaaaactgacacgattagcccacctcgtaaaggagagaggccttgnccacctcgcccatcaacatgattagcgtcg

SEQ ID NO: 51742 - DNA, 101 bp, rice(Oryza sativa)
  misc_feature (71): n=t or c
aattcaaaacacacatccttcaatatgctgcaatcatgctgatcagttagggcaaacatctccttgacgtngcctaagctaaggaccttgcagagtccgtc

SEQ ID NO: 51743 - DNA, 101 bp, rice(Oryza sativa)
  misc_feature (71): n=t or c
tttgttccggagaaaagtgcagctgcagcaatccatggcaacaacaccgataccaactggtatgcagatanggcggcgacagaccacatcaccggcgagct

SEQ ID NO: 51744 - DNA, 101 bp, rice(Oryza sativa)
  misc_feature (71): n=t or c
gacctaccctgtcagccacccagccgactcaatgccaacttgatatatatccggtccggcgaaaacacaangcaaaaagaaagaagaagacaaagagagag

SEQ ID NO: 51745 - DNA, 101 bp, rice(Oryza sativa)
  misc_feature (71): n=t or c
gtacaatgatttggatacggcagatccggcagcagaagagaacattactcattacccacccaaccacctgngcatgtgtgcgtgcacactactcgctccgt

SEQ ID NO: 51746 - DNA, 101 bp, rice(Oryza sativa)
  misc_feature (71): n=t or g
aaattttgcccttcgtgtggactggccaacgtcagcaagagcactaagtccagctccaaaatacataaganaacaattgttggagttgcttaatcccaact

SEQ ID NO: 51747 - DNA, 101 bp, rice(Oryza sativa)
  misc_feature (71): n=t or g
acagtagttactaggatatagttgtattacctgtacatagaatatgcagcccaagtgggaggaaagcaatnaagcaaacaacagtagtgttgtataatcaa

SEQ ID NO: 51748 - DNA, 101 bp, rice(Oryza sativa)
  misc_feature (71): n=t or c
tggttgattggttgatgttgtcatgcgcacgtggatagacatctcttttcacgtacaattttagctaattncttctatgcccctgaatttttcttacttgt

SEQ ID NO: 51749 - DNA, 101 bp, rice(Oryza sativa)
  misc_feature (71): n=a or g
ctcttccaccactttggcgagacaatagtgagcttgaggttcactgcttcctcttccttggcgagacattngtatccctttcttcctcctcatcctcagcc

SEQ ID NO: 51750 - DNA, 101 bp, rice(Oryza sativa)
  misc_feature (71): n=t or c
ggccactgtcatctgcaaccgaggtcgtcaggggcgtcatcatcaaggtcgtcgagggcaccgtcgtcgangtcaaggtcgtcgggcgccatcgattgccg

SEQ ID NO: 51751 - DNA, 101 bp, rice(Oryza sativa)
  misc_feature (71): n=a or g
aatcttgtcagccttgttgatgtaaaaatcatatctttcttccttcccaaaactcttcacccatgggctcnctataatctttttgcttctggcccactcgg

SEQ ID NO: 51752 - DNA, 101 bp, rice(Oryza sativa)
  misc_feature (71): n=a or g
cacctgaggttgacctgtttagggctgtgttcaccattgcttccctaccggtgtacgtacggaaaacggancggtttattagcgcgtgattaattaagtat

SEQ ID NO: 51753 - DNA, 101 bp, rice(Oryza sativa)
  misc_feature (71): n=t or c
ttgtagtgtatattacctctagtacactagcttcaatacattgtaaaacttttgtttgatctgtttgctcncaatatattgctcatgcatttttctatcct

SEQ ID NO: 51754 - DNA, 101 bp, rice(Oryza sativa)
  misc_feature (71): n=a or g
caacttcttcagagatctgagattgctgatggagctcggaatcatacctgtgaagtttgttctactgacgnacaaattctccaagctactgtcctgtgaga

SEQ ID NO: 51755 - DNA, 101 bp, rice(Oryza sativa)
  misc_feature (71): n=a or g
agtggaatacttcctccgtcccggaaagcctgtcattccgctattcaaaaaatgtcccacaaaatttatcnttctagcatcttgacagcatcttgaccaac

SEQ ID NO: 51756 - DNA, 101 bp, rice(Oryza sativa)
  misc_feature (71): n=t or c
cactccctttgagagtgtcagctggattctatttcgatttcaagcgacttacaagcagactaaaagccggngcacaacagccagcggcggcggcggcggcg

SEQ ID NO: 51757 - DNA, 101 bp, rice(Oryza sativa)
  misc_feature (71): n=a or g
gatgagagagacaaaatagatttattcagccatacaagaaatgacccaaacagatgagggatgaaaaatanatttattccaaccatataagagacggccca

SEQ ID NO: 51758 - DNA, 101 bp, rice(Oryza sativa)
  misc_feature (71): n=a or g
cacacgatcgtgaggcagtcgtctctgagatactccgacgattccagaagccccctttcgatgtaagtccngtaaccccaaccggtgttgaggaagacgtc

SEQ ID NO: 51759 - DNA, 101 bp, rice(Oryza sativa)
  misc_feature (71): n=a or g
aaatcaaattggtcttggacaaggaacgctctaacaatgacactgaagtggcaagtatggttaaaaagatnaaggacaaatttgacaagtattggcttaag

SEQ ID NO: 51760 - DNA, 101 bp, rice(Oryza sativa)
  misc_feature (71): n=a or g
aatgaacaaaagatgtgttttctttcttagggatttgtgcagtggactggaatgtctatttgagcatggtntctatccaattcaaatcactgccaaggaca

SEQ ID NO: 51761 - DNA, 101 bp, rice(Oryza sativa)
  misc_feature (71): n=a or c
ttattccacagcgaaacgatggccaggaatgtttggtcttttggtaatcaaccatgtggacttagcaaaanattgagaattaatctaaagcttcccagaac

SEQ ID NO: 51762 - DNA, 101 bp, rice(Oryza sativa)
  misc_feature (71): n=a or g
atgctgcgagattattgctgctgattcttgactcgatgtcgatgacgacgacacgaagaagaacgcggccnctgaggagaccgagatcaatccctctcagc

SEQ ID NO: 51763 - DNA, 101 bp, rice(Oryza sativa)
  misc_feature (71): n=a or c
caagtgaacaatgcaggagtgtcgatttgggaaccaaaccagcgcggcgatgagcttggcgttcttcccgngctcgcgggtgaccacgacgtcgggaggag

SEQ ID NO: 51764 - DNA, 101 bp, rice(Oryza sativa)
  misc_feature (71): n=a or g
tcctttgatggccaatccaaaaacccgaaagttttggccgtcttaccgagtctctgaaaatctcgacaccncctatctataaatcttggcttcgcctctta

SEQ ID NO: 51765 - DNA, 101 bp, rice(Oryza sativa)
  misc_feature (71): n=t or c
tgaattcttctataatttgtatggaaaatggacactggttgttgcaaactaattgaatcagaaacatactnccattgttttatccacgtcatcatgagtta

SEQ ID NO: 51766 - DNA, 101 bp, rice(Oryza sativa)
  misc_feature (71): n=t or c
aaaccaaaatctgaacataaggcaaaagttcacatatgtccatttgaactaaactgaagaattgttggtanaaaatgaacagaaccaaagagacaaaatct

SEQ ID NO: 51767 - DNA, 101 bp, rice(Oryza sativa)
  misc_feature (71): n=t or c
tttgtgtattctaaattcaactcttccaaagaattcaacgagcacattggcaaccgttccatgaattcccntaagtccgcatcaatattgttgccatccat

SEQ ID NO: 51768 - DNA, 101 bp, rice(Oryza sativa)
  misc_feature (71): n=t or c
actccatttctgctaaatcactggagcatcaatataggggagagaaatgaactggagctcctagtatgaanagttaccaaaaaaaaatgcccttcttatat

SEQ ID NO: 51769 - DNA, 101 bp, rice(Oryza sativa)
  misc_feature (71): n=a or g
tcgtccccagccggcgaaggtgagtttcccgtgcctgtttttgcttttttttttcagcaattggtggagcnagacataccaaatgtgaatcaccgtcgacc

SEQ ID NO: 51770 - DNA, 101 bp, rice(Oryza sativa)
  misc_feature (71): n=t or c
caaatgtcctctcccaagatattgctggtggcttttcacaatccatgtgcaggactgcctaaagcaagaanagtactttcagagtgagactggctaacttt

SEQ ID NO: 51771 - DNA, 101 bp, rice(Oryza sativa)
  misc_feature (71): n=a or g
cgttcccaaaccgtgtcgtcattggcaccaccactaccatcgtgttcccggcgccactctatcatgagccntcatcgggtgtcccggcacagagctccacc

SEQ ID NO: 51772 - DNA, 101 bp, rice(Oryza sativa)
  misc_feature (71): n=t or g
gtcaaagatgttcgaaacagaatatcaaagggagttcttctgtggccaattaactcctgagcttaggttgngttacttcaacaaatggtgcaaggacaaca

SEQ ID NO: 51773 - DNA, 101 bp, rice(Oryza sativa)
  misc_feature (71): n=t or g
ttgaacttttagagaaatgaatggattactgtgcagcccgtcaattatattggtttttgtttatttgtaantttggctcttataaatatcgtatactaaaa

SEQ ID NO: 51774 - DNA, 101 bp, rice(Oryza sativa)
  misc_feature (71): n=a or g
ataatttgacctcaatgctaggaatattcaaagatgtaggtccataggaggagagatataaaatgggtaantgatcggtgagaccatattcaatgatgggg

SEQ ID NO: 51775 - DNA, 101 bp, rice(Oryza sativa)
  misc_feature (71): n=t or c
aattttttttatccaatggcacggccttgcccttgcctaattggtccttggggcttttcagggattttacnatatttgatccagtattaatactaacgtta

SEQ ID NO: 51776 - DNA, 101 bp, rice(Oryza sativa)
  misc_feature (71): n=a or c
gtatttactttcaacataaccatcatttagttacgttggatgatacttcattcctctcataatatatcaanctagttagtattagattggacacatcctag

SEQ ID NO: 51777 - DNA, 101 bp, rice(Oryza sativa)
  misc_feature (71): n=a or g
taaacgcaagtgaaaagccgcctccggtacttattgaagcctattaccaccacctcaaagggactggagtngcagccgccgtgcacatgcccatccacgca

SEQ ID NO: 51778 - DNA, 101 bp, rice(Oryza sativa)
  misc_feature (71): n=t or c
attcctccaatagtaaacgtacacgtcactaaacgaacaccacgtaggaaaggatagtggataagaaatangttgtttttgttatatatagaaaagtgtta

SEQ ID NO: 51779 - DNA, 101 bp, rice(Oryza sativa)
  misc_feature (71): n=t or g
ttactgtcatatgcaacacaaagttaccgaaaagaaaagcaataagcagaaagaacaggccaagaattaantaatcacctgcagctgtagtgaaatattgg

SEQ ID NO: 51780 - DNA, 101 bp, rice(Oryza sativa)
  misc_feature (71): n=t or c
aaaaaattttctgatcgcctgtcgcattgctctgctcttccgtggtcgttactgcatttgcttatgctttnctcgcattttacgtttctcgttttggatcg

SEQ ID NO: 51781 - DNA, 101 bp, rice(Oryza sativa)
  misc_feature (71): n=a or g
ggaagccatgtttctgcgttttcctagcatttgtctggccccaggtaatcgaggatgtttctgaagcatcntaattcatagagccgtagaggatgaatacg

SEQ ID NO: 51782 - DNA, 101 bp, rice(Oryza sativa)
  misc_feature (71): n=a or g
gatggaaatgaagtccttaaaaggattggtgagatatcagatttattgcaggagcaatttggtctgaaagnccattcagacggaacaatgcatggtgattt

SEQ ID NO: 51783 - DNA, 101 bp, rice(Oryza sativa)
  misc_feature (71): n=a or g
agtagatccaccatgtttgttccttgcaattatagaggaaactacacaaaaaaaatgagtttagtacatanccaaagtctgctagatgctgataactacaa

SEQ ID NO: 51784 - DNA, 101 bp, rice(Oryza sativa)
  misc_feature (71): n=a or g
ctatgttctttgggaaaacctacgctaatcactttagtcagcacgtgaagcacgatctcatgatgcgatgntccatcttgaaggttggttgggaaagttgc

SEQ ID NO: 51785 - DNA, 101 bp, rice(Oryza sativa)
  misc_feature (71): n=a or g
ccataggccaagatggactgatgtcccttggccccgcattagctatgacccagtaaaatctgcaaaaaatnaaagcataagcaatgtaataataaattatt

SEQ ID NO: 51786 - DNA, 101 bp, rice(Oryza sativa)
  misc_feature (71): n=a or g
gggagcaccagttgtgtggtggagtactgctagctgtgggtgcactacttaaatgagagttcaaatcctgntactcacgaatactacgttcatgtgaatat

SEQ ID NO: 51787 - DNA, 101 bp, rice(Oryza sativa)
  misc_feature (71): n=t or c
tccccattgtcataccttagcgtgtagcgcctacgattccgttcttttattcaacaaaagattttcgtganaaacttttcaaactgctaaacgatacgttt

SEQ ID NO: 51788 - DNA, 101 bp, rice(Oryza sativa)
  misc_feature (71): n=t or g
taattaaattataatgtctcttggtggatttcgtgattcaattatgcatagttttgtttaaaagtgagttnccacacaacttagcaaagatcacaacatga

SEQ ID NO: 51789 - DNA, 101 bp, rice(Oryza sativa)
  misc_feature (71): n=a or g
gtagatattcgacagaccaatgtaccggccatcgtggtctggctgcaaatggacaagctgcctgccgactncctcccccagctccacccatccatggagat

SEQ ID NO: 51790 - DNA, 101 bp, rice(Oryza sativa)
  misc_feature (71): n=a or g
ggcttaggcttcaggctttcagtgttctctgtttcttcgcacctgtctgtaattattcgtgtataaggctnaaatgctgaattgttcagccagtcgcccca

SEQ ID NO: 51791 - DNA, 101 bp, rice(Oryza sativa)
  misc_feature (71): n=a or g
ttcggttggcttatgatacataagaagatcctcacagctgacaaactcagcctccgcggctgggacaacanccacatctgcccactttgtggtgtggaacc

SEQ ID NO: 51792 - DNA, 101 bp, rice(Oryza sativa)
  misc_feature (71): n=a or g
agtccagcttagcatttcccaccaaccagcacatcaatagacccttttgctagtagccatatcgaacaatnttcagagtcggtttgtaaaggaggagcaga

SEQ ID NO: 51793 - DNA, 101 bp, rice(Oryza sativa)
  misc_feature (71): n=a or g
accagttaagaataatgaattgccagaactagccagaggtaatgaaatgtatcctgttgccaagccaagcnagtgttttgatatattccttaacctatttg

SEQ ID NO: 51794 - DNA, 101 bp, rice(Oryza sativa)
  misc_feature (71): n=t or c
ttcatcatcacaatcactagcagaagtatacttaccatcagcgttcacaaatagagctcgccgatttgganagtcacatgcaatgtgtccaatgccatggc

SEQ ID NO: 51795 - DNA, 101 bp, rice(Oryza sativa)
  misc_feature (71): n=a or c
ttagtcccctctcaagcattttttttactcatgaaggcagtactagtcgaccatccaaagatgatgcatanctagaaatcacattcccacattatgagcat

SEQ ID NO: 51796 - DNA, 101 bp, rice(Oryza sativa)
  misc_feature (71): n=t or c
ccgttaacaaggctcgccataccacttcctcccccacccttcctactcctccaaagtcgagcggaaggtancacagttctttccctatctacggtggctcg

SEQ ID NO: 51797 - DNA, 101 bp, rice(Oryza sativa)
  misc_feature (71): n=t or c
agtattagctaagctgagctgaggctgagctagctacaccaaatgggcaacctctaattaattacttctcncatcctaaaatataagcatttttgatcttt

SEQ ID NO: 51798 - DNA, 101 bp, rice(Oryza sativa)
  misc_feature (71): n=t or c
atataaaaattaactgttcacaattagtgctaaatgcatataataaactttcaaattactccctctatttnatattataaattgttttcgatttttttctt

SEQ ID NO: 51799 - DNA, 101 bp, rice(Oryza sativa)
  misc_feature (71): n=t or c
taggggcaattgcatatttgatcctattttaaaggttaactaccaacttgaccctgttataataactttgntcatttgaccctctttttcaaaactgaagc

SEQ ID NO: 51800 - DNA, 101 bp, rice(Oryza sativa)
  misc_feature (71): n=t or g
gggacaacctgatttggagcatactgcataagttgaccactaggtgttgccaacccagccgacgcatccancaaaccttgctgctgaatcggctgaacggc

SEQ ID NO: 51801 - DNA, 101 bp, rice(Oryza sativa)
  misc_feature (71): n=a or c
gtaagtactagtaaatctcagcgattgccgattggcttgatatttatgaatgcgaatgcatagcaccatgnctctaatatatagatgaaccagaacacagt

SEQ ID NO: 51802 - DNA, 101 bp, rice(Oryza sativa)
  misc_feature (71): n=t or c
gctagaagagccagaggtgaatgctttaaatgtggagagaaatttggcccaaggcacaagtgtccaaaatntgtgcaactttaggtgctggaggaactttt

SEQ ID NO: 51803 - DNA, 101 bp, rice(Oryza sativa)
  misc_feature (71): n=t or c
catagccttggctcacatctcaagtgtagagagcgacacgcgagtttggacaagcgagtgcaaaaatcgcnaactggtactcaaccagtgcagccgtgagg

SEQ ID NO: 51804 - DNA, 101 bp, rice(Oryza sativa)
  misc_feature (71): n=t or c
cctagctatttcatttgacatggatcaaacatccaatccgaagaaattttgtaacaaatctcatgggcacnttagtataaccacacacttttagttttatg

SEQ ID NO: 51805 - DNA, 101 bp, rice(Oryza sativa)
  misc_feature (71): n=t or c
ttagaagagattaacaacagcgagagctgcgaagcaatgcattgcggattaacaagaacgagagctgaagnaatgcctcgcaaaatgtcacatgtgaaagt

SEQ ID NO: 51806 - DNA, 101 bp, rice(Oryza sativa)
  misc_feature (71): n=a or c
tgcctccacttatacctatgcttaaactaatgctttgctctaaacaatgattagcactggtggttaggtgnacaatctctctcacacaaacactaactaca

SEQ ID NO: 51807 - DNA, 101 bp, rice(Oryza sativa)
  misc_feature (71): n=a or g
atgaaaaaaaatttagtgggggcttagagggttctcgactatcccagaaaaaaaattattgggggtttatnggggccccactgtcccggggacggtaatgg

SEQ ID NO: 51808 - DNA, 101 bp, rice(Oryza sativa)
  misc_feature (71): n=t or c
aaacgtatcgtttattagtttaaaaagcatgcgcgtggaaaaagcccccttcccggaaggcttccttcgcnggaccaagggaagggggctcgtggtcatgt

SEQ ID NO: 51809 - DNA, 101 bp, rice(Oryza sativa)
  misc_feature (71): n=a or g
atataaatttgaacacgtatataaaacacatacatataaccatatatgaaatctatttaaaacccaaaatntcttataatataaatcagagaaagtagtat

SEQ ID NO: 51810 - DNA, 101 bp, rice(Oryza sativa)
  misc_feature (71): n=t or c
ctggtggtatgttgctttggtggctttatttgcccacacatttatttatatataggtgtaaacatgaacgnttttcatgtgatgtatctgtttagtgaatc

SEQ ID NO: 51811 - DNA, 101 bp, rice(Oryza sativa)
  misc_feature (71): n=t or c
tgacaagtgggagcaagagattgaagcgaagtttgttctaaagaaaacttggtttaaagtttatggagtgncatatgagattagagactttctcagtctac

SEQ ID NO: 51812 - DNA, 101 bp, rice(Oryza sativa)
  misc_feature (71): n=t or c
tttgcttcgaatcaccctttaaccaatgttttttttatcttatttttaacctttgtggcactttaggcccngtttggcacagctctagctcccaactccaa

SEQ ID NO: 51813 - DNA, 101 bp, rice(Oryza sativa)
  misc_feature (71): n=t or g
tagggtatcgttgacgattgacgagaaatgcgtcgtgacctagcaagttttggatgctgcttaactttttnggggtgtttagattgaggggtgtaaagttt

SEQ ID NO: 51814 - DNA, 101 bp, rice(Oryza sativa)
  misc_feature (71): n=t or c
tcaatagaaacatagtgaaaaaaccaaacctagatcttcatcttgctgaactcttttaggcctttgtgcanatttcttccggttcattcgcattttccttg

SEQ ID NO: 51815 - DNA, 101 bp, rice(Oryza sativa)
  misc_feature (71): n=a or g
agcgaaaatcgattttcactggcggttgcttaagtgggccgccagtataaataattgtatctttcctatcngactatataacccaaccgccagcgaaaatg

SEQ ID NO: 51816 - DNA, 101 bp, rice(Oryza sativa)
  misc_feature (71): n=a or c
atttagatatatacatgtaagagtatcacaagggaagatgaaccatccgttgaatttttcttactccctcngttttaaattacttatatatcattctaatt

SEQ ID NO: 51817 - DNA, 101 bp, rice(Oryza sativa)
  misc_feature (71): n=a or g
atcttccctggacttcacgatctgccggaggcagtagtcggagcactcgtggtacgggttcgacgagttgncgcaatccggccgcgacttccccggcggcg

SEQ ID NO: 51818 - DNA, 101 bp, rice(Oryza sativa)
  misc_feature (71): n=t or c
gtgaagagataggtgtcagttttgaataataatcggcacctattgtaatagtgtcggtttttttaaagaanaggcacctataatatattatagattctggt

SEQ ID NO: 51819 - DNA, 101 bp, rice(Oryza sativa)
  misc_feature (71): n=t or c
gattacaattgccatcagtagatctttcagacctagatggtgattttgaggaagaagaagtcaaggaagcngttgcaaacttggcaccaaagaaggcgccg

SEQ ID NO: 51820 - DNA, 101 bp, rice(Oryza sativa)
  misc_feature (71): n=a or g
gctgcaccgaactacaacaaaaatggaagaagaaaagtgacatagttaggagctgagggacctcttatatnttttctctattattttttcaagaagcttcc

SEQ ID NO: 51821 - DNA, 101 bp, rice(Oryza sativa)
  misc_feature (71): n=a or c
atgacgacgacgactgcatcaatgtcattttcatggtcacggacgaccaacgatttcatgccaattaaccngtgtttgtgcaaggaaaagaagaacagatg

SEQ ID NO: 51822 - DNA, 101 bp, rice(Oryza sativa)
  misc_feature (71): n=a or g
tctgtgctacataactaatagacgcaacaccaccacaaattgaatgtccaaagcagttctgggctcaatcntgtaataggacagagaggagaaattgtcca

SEQ ID NO: 51823 - DNA, 101 bp, rice(Oryza sativa)
  misc_feature (71): n=a or g
cctcacgctggaccggtgcgtgccatcacattggctgctgctactactccgatacacttgcagctctgctncacctgcacctgcagtgacgagtagtagta

SEQ ID NO: 51824 - DNA, 101 bp, rice(Oryza sativa)
  misc_feature (71): n=a or g
cacgattggcaaagcaaaagtgcaaagggagaaatttatcgacatcgcttaggccgtgtgcagtgtgcgancaatcttcatcacacgaacggagaaaggat

SEQ ID NO: 51825 - DNA, 101 bp, rice(Oryza sativa)
  misc_feature (71): n=a or c
ttttcaggcgcttgaaaatttaaagagtttcattatttttttccctggatgataatttaatttttctcatnactcccctattatttattacttatctctcc

SEQ ID NO: 51826 - DNA, 101 bp, rice(Oryza sativa)
  misc_feature (71): n=a or c
aagaattagtcgacgagtgcagatataaccgggctggtattgcctcctgggcacgtggggcccgcgctgcngcctcgcggggatgtatcacatggactcgt

SEQ ID NO: 51827 - DNA, 101 bp, rice(Oryza sativa)
  misc_feature (71): n=a or g
gactgaccctgacttcatgttttctatgcaactcgatgaagacaacaggatcaagtctttgatgtggtgtngtggccgcagcagaaggatgtatagccact

SEQ ID NO: 51828 - DNA, 101 bp, rice(Oryza sativa)
  misc_feature (71): n=t or c
cctcaagagcttcctcgccgaggtcagcgaggccgaacgcgacaacgaagtgctcaggtaaatcccccccnctctctctctccctccctttcccccctcgt

SEQ ID NO: 51829 - DNA, 101 bp, rice(Oryza sativa)
  misc_feature (71): n=a or c
tattttggtgaggattgtggtagttcaaaccggctgggtgctacaaccgtttacaatgtcacagccgtagncgttgcggcagcaaggccagccgaatgcac

SEQ ID NO: 51830 - DNA, 101 bp, rice(Oryza sativa)
  misc_feature (71): n=t or c
gccgccgccgggcggagtcagagcagcggtggatcttgctcatcgatgcagcgcggtcgacgccgctcganactgatctagctgcgaggggggaccagatc

SEQ ID NO: 51831 - DNA, 101 bp, rice(Oryza sativa)
  misc_feature (71): n=a or g
atattaggaaaccttctctctccgatggaaaaaacataggaccaaatctaacagtggcatttagaaagganccacttattaatagtggactagcactgata

SEQ ID NO: 51832 - DNA, 101 bp, rice(Oryza sativa)
  misc_feature (71): n=a or g
attagactaatcgtcatgttgctcatattacttctatgtgggtttaggtttctcacagctagtcatgatcntacaggagtctgatgtacgagtcgtacgca

SEQ ID NO: 51833 - DNA, 101 bp, rice(Oryza sativa)
  misc_feature (71): n=a or g
gaatgattaggcgataacattaattgtttctttttcagcaattcgtggaggccgtgctgattggtctgctngttgtcgcagccgtcggcctcgtcgtcctg

SEQ ID NO: 51834 - DNA, 101 bp, rice(Oryza sativa)
  misc_feature (71): n=t or c
tcatgtacaagggaaataatgtaggcatgcatgcatctaaagggagtatatattattactcactgatttgnaaaatgcatgaaaaattcaagccatttgga

SEQ ID NO: 51835 - DNA, 101 bp, rice(Oryza sativa)
  misc_feature (71): n=a or g
aagctttatcgcgatctccgggtacttgacagcgaaacggtcgacatagtcctgcatgttggggtacccancggcgcagagaaatcggccggcgatggatg

SEQ ID NO: 51836 - DNA, 101 bp, rice(Oryza sativa)
  misc_feature (71): n=t or c
tcaagggtagagatgagcctgcatggtctccggaacattacttgcttaaacctgataatgcaaaagctaancaagcacgcttgccaagcctcctccatcgc

SEQ ID NO: 51837 - DNA, 101 bp, rice(Oryza sativa)
  misc_feature (71): n=a or g
ttagacagtgctcctgatgatgaagaaaaaccaacggattcatatatgtactcatacaagcaccgcgtgtntacaaataatttcttcatgtggttcattag

SEQ ID NO: 51838 - DNA, 101 bp, rice(Oryza sativa)
  misc_feature (71): n=a or g
cgtcaacgtgttttagatgaacaacatgtcccttatcatgacgtgcagatgtatatgatgatatggtattngtaatatccggtggatgcggattatccggt

SEQ ID NO: 51839 - DNA, 101 bp, rice(Oryza sativa)
  misc_feature (71): n=a or c
gtgtccgccctcgtcgtgcctgccatgcgcaatgtgcatactgccctcaagaaggccggcctgcacaagangatcaccatctcgagcacgcactcgctcgg

SEQ ID NO: 51840 - DNA, 101 bp, rice(Oryza sativa)
  misc_feature (71): n=a or g
gggctggtcgagtttcagggcgaacgatctcaccccttgctgttccatggcgtaccgaatccacgcgttgncgtgtgcgccgtggacggccggcacggccc

SEQ ID NO: 51841 - DNA, 101 bp, rice(Oryza sativa)
  misc_feature (71): n=a or c
acctcccttcctcaccacacgcaagatctttccccccactacacaattatcacaaaacaccctgaacaaanatatcaccaccaaaacacccctcctccgtc

SEQ ID NO: 51842 - DNA, 101 bp, rice(Oryza sativa)
  misc_feature (71): n=a or g
catactgcgtttgaatcatattggttcgaatcctttctctctagcccataaaataaggtagctcattaacnttatgattaataaaaatattagcttaacaa

SEQ ID NO: 51843 - DNA, 101 bp, rice(Oryza sativa)
  misc_feature (71): n=t or c
acctcctaaactgtttatgcaattcgccagcaattgtaccacatgtcccaaagagatagatgcaaagggantaaggacatgcaggatcttggttgtgaaag

SEQ ID NO: 51844 - DNA, 101 bp, rice(Oryza sativa)
  misc_feature (71): n=a or g
cgatgctgatacgagatttctcgaaggctaaatcctatgaaatgacattgaatttcaatcggaatacaatntgtaaaatagagaactataaatcaatttat

SEQ ID NO: 51845 - DNA, 101 bp, rice(Oryza sativa)
  misc_feature (71): n=t or c
gcaagaagaccatcgcagataagcacttcctcctcggatttcgtcatcccaagcaatttacaagcctgctncgaattcatgacagaaacgatgctgtaaat

SEQ ID NO: 51846 - DNA, 101 bp, rice(Oryza sativa)
  misc_feature (71): n=a or g
gaacgggcgctacaggtaatcagtaactctagagaacatcaaccaaacaaaaaagtttattgatcttttcntactcaattgatgtgaagatacgtcgtgtc

SEQ ID NO: 51847 - DNA, 101 bp, rice(Oryza sativa)
  misc_feature (71): n=t or c
cagctcgccgaccttccccctagcacatcaggaggggtggatactcggctctgttcggtctggctcggttnggtctggctcattaggataacgagctagtt

SEQ ID NO: 51848 - DNA, 101 bp, rice(Oryza sativa)
  misc_feature (71): n=a or g
ctatccgggcggcctcctgcccttctcttcacctctctttactcccatcactaacaccggcccattacctntcaccgaccccgtggctctagtggcggtgg

SEQ ID NO: 51849 - DNA, 101 bp, rice(Oryza sativa)
  misc_feature (71): n=a or c
gaaggatcgcgctgttatccaacaaggttggaggcatcttggacgaaggatgtatggcaaaagcggatggnttcgccataacaagttcaacttcaaggagg

SEQ ID NO: 51850 - DNA, 101 bp, rice(Oryza sativa)
  misc_feature (71): n=a or c
aacgcatttaccttttatctggacataaatatcggtctacttcacctaaaccagtatcaatatgatgttgngcatcattttgtttggagcgatttctacat

SEQ ID NO: 51851 - DNA, 101 bp, rice(Oryza sativa)
  misc_feature (71): n=t or c
tgttcacttgcactcttgctgctctgctcccatgtcttccagcttctctcagacgctcgccgccgtcttcnaccgggcccgaggccgcttccggtcatcgg

SEQ ID NO: 51852 - DNA, 101 bp, rice(Oryza sativa)
  misc_feature (71): n=t or c
agtggtgaaccccacgtcggcgccatcgagcgtgcagctcgctagcctccgcgagaagtaggcatcgaaanggccgcaaccgcacaccctgagtggcacag

SEQ ID NO: 51853 - DNA, 101 bp, rice(Oryza sativa)
  misc_feature (71): n=t or g
gagcatcccgccacttctccagccctattaggcttagtagcctttttatttgtttgcacagtgcacgtgtncattgcactgcaatttgagtccatgcaaaa

SEQ ID NO: 51854 - DNA, 101 bp, rice(Oryza sativa)
  misc_feature (71): n=a or g
caatgttgttttttgaaggtcttggaatcgaacagctaccacggtgagtatatattattagggtttctacnttcgtcgacgtcttattttctctacgccag

SEQ ID NO: 51855 - DNA, 101 bp, rice(Oryza sativa)
  misc_feature (71): n=t or g
aacgaaaaggtgaggccctaagcgtgtggagacgtgtgggtggaacggtctttttccccgtaagatatgtngtgtttttaggacacgggacccgggcaagt

SEQ ID NO: 51856 - DNA, 101 bp, rice(Oryza sativa)
  misc_feature (71): n=a or g
tctgaactcccagagtgcgcgcgtggtatactagccgcgttttatcaactcagatccacatgtaatagtcngaagagatgtctgcatgccccatcctgtaa

SEQ ID NO: 51857 - DNA, 101 bp, rice(Oryza sativa)
  misc_feature (71): n=a or g
cgtctcgatcacatcctcccttggtactgtcggctcataaaggtgctcaacaaaaacatatgaaggggctncttctcgctttgaaccgaaattagctagtc

SEQ ID NO: 51858 - DNA, 101 bp, rice(Oryza sativa)
  misc_feature (71): n=t or c
atcaacatctaaccttctgtctgtcggtaaaagcttgtgacataccatctgtcgggaactctatggttttntaggggcaaactttctgtcgctgattgtta

SEQ ID NO: 51859 - DNA, 101 bp, rice(Oryza sativa)
  misc_feature (71): n=a or g
gcagccggtgtgctgttcaccggctgcgcgagtggtttgatccccaatggtgcagtctcggtatttccatnctttaattttcttggaccttcaatgtcatc

SEQ ID NO: 51860 - DNA, 101 bp, rice(Oryza sativa)
  misc_feature (71): n=a or g
aataatttgccgatttgaatcacacatggatttgcagtttccaattctaaagatgccgcaactgataggtntatcctgctccaaccattgcttctcctgtt

SEQ ID NO: 51861 - DNA, 101 bp, rice(Oryza sativa)
  misc_feature (71): n=t or g
tccctcactgtgtttaatgcagtaagggcagtcgtgtggtgccgtctagctgacccccgtcaattaggacntgaccagtctatgacgggcctgtcgccggt

SEQ ID NO: 51862 - DNA, 101 bp, rice(Oryza sativa)
  misc_feature (71): n=a or g
gagcattttattttcggttaacctaagttttatttggagggagagacgttttactcctagtttgttgttcnatagtagagatgataatcatgagtcaagtg

SEQ ID NO: 51863 - DNA, 101 bp, rice(Oryza sativa)
  misc_feature (71): n=a or g
attacgatttaagtcaacaaaatgactatgaattatcgatataatgcaactaaggcatatactccctccgnaaaaaaaaatctaattgtaggatgaatatg

SEQ ID NO: 51864 - DNA, 101 bp, rice(Oryza sativa)
  misc_feature (71): n=a or g
ttagcttactttgttaggtttctttctccgatcctcttctcagagcttagagattgagcttggatcattgnacgaagctgcatcaagcccattttgccgac

SEQ ID NO: 51865 - DNA, 101 bp, rice(Oryza sativa)
  misc_feature (71): n=t or c
cgttctaaggctgcgatcggaactacgagtacccatattctgctccctcatttttcgttaacacgtttcanggactgttacattgcttttttaaaaaaaaa

SEQ ID NO: 51866 - DNA, 101 bp, rice(Oryza sativa)
  misc_feature (71): n=t or c
gccataatcaatatttgttcggctagaaatatccccttggatgaaaagaggcccattacacacaagacttnagattttcaggcattgggatccgtgacctg

SEQ ID NO: 51867 - DNA, 101 bp, rice(Oryza sativa)
  misc_feature (71): n=t or c
caaaataccaacaccactgcacttcatagctcccaaagaagcgcaacctatcccaactcctatctcttctncaccaccaccaacaacaacaacacatgaat

SEQ ID NO: 51868 - DNA, 101 bp, rice(Oryza sativa)
  misc_feature (71): n=a or g
acttgtccgaaattcattttcagaattttcgaaactggcagtgaagttaaaatgtcttctggaaattttcngatttttccaaaatattttcagaatttctg

SEQ ID NO: 51869 - DNA, 101 bp, rice(Oryza sativa)
  misc_feature (71): n=a or g
gcttaattaatttttaaattttggcgggctttgcacccgaagaaggtgaaggatttcatttgttgggggcngctgatcagtccttggtaatggcggggatg

SEQ ID NO: 51870 - DNA, 101 bp, rice(Oryza sativa)
  misc_feature (71): n=a or g
tctatcatgacgcagaaggagatgtgccgcatgcgcgaaaatggcagaagggatcgaatccaacgcctgcntagggactaggagagggagagagagagaga

SEQ ID NO: 51871 - DNA, 101 bp, rice(Oryza sativa)
  misc_feature (71): n=t or c
cttttgtttccgcgctctttggaattgtttcggtagtttttatatgtttttagtcaatgacatgtagtacncacgtgagtcaatgacatgtggatcaggat

SEQ ID NO: 51872 - DNA, 101 bp, rice(Oryza sativa)
  misc_feature (71): n=a or g
tgcacgtacaataccagaaccaccgtcattattaattaaaacctccgtgtactccctccgtactcataaanaaagttgttttggttagcgacacggtctcc

SEQ ID NO: 51873 - DNA, 101 bp, rice(Oryza sativa)
  misc_feature (71): n=a or g
tgtggggatgacaagtgggggagaggagaggatcgtgttgcctaattccccttttataataggtgagcagntaactatgtgcgtcaagccgtcgattaatg

SEQ ID NO: 51874 - DNA, 101 bp, rice(Oryza sativa)
  misc_feature (71): n=t or g
ctttcactatataagataagataataagatatgatgatagccaccggccggaatacacaggagactaacantgctctgattttcttttctctcgggctgaa

SEQ ID NO: 51875 - DNA, 101 bp, rice(Oryza sativa)
  misc_feature (71): n=a or g
gcaaaacaatgcattatggatgttttaattgacactgttattatgtatccttcgcagagtttcccagtganctattacgcagacatggcagcgatggccgt

SEQ ID NO: 51876 - DNA, 101 bp, rice(Oryza sativa)
  misc_feature (71): n=a or g
cgaggggcgtcggtgcagtggtgtacacgcgctgacagtgaagggtcagtggttggagcaatggagaacanctttcgatcagcaggaggtggacaacgggt

SEQ ID NO: 51877 - DNA, 101 bp, rice(Oryza sativa)
  misc_feature (71): n=a or g
ccggcagccttcaccgccgaaacttcattgggtttgtcttcccggcagttagattgttttctaactacagnttaacctcgtgttactctcctgtttttgca

SEQ ID NO: 51878 - DNA, 101 bp, rice(Oryza sativa)
  misc_feature (71): n=t or c
tatcttgtttacattgcggcatttcacatttttcattccctgttgttttgttcaattctctggaggaaagntatttatttccatggtacgtctcatctagt

SEQ ID NO: 51879 - DNA, 101 bp, rice(Oryza sativa)
  misc_feature (71): n=t or c
cgaccatcgatctggagcacgccaaaataactatcaacgatcatctcctcccactctggcagtagtgagcngccatcttcgagctcgtactccaccttaag

SEQ ID NO: 51880 - DNA, 101 bp, rice(Oryza sativa)
  misc_feature (71): n=a or g
acatggagatggactttcatctctcaaggggcatacccatttcttacatatatgcatgccacacctaaatnatcatgaaagtttttaacaagatagattaa

SEQ ID NO: 51881 - DNA, 101 bp, rice(Oryza sativa)
  misc_feature (71): n=t or c
gacaacattgggaaacttgttcagctgaattatctaaatttggataggaacaacttgagtggaagcatacntctgagtatagggtattgtactcaactcga

SEQ ID NO: 51882 - DNA, 101 bp, rice(Oryza sativa)
  misc_feature (71): n=t or c
attaaacttccttaaaacgctctcaggcggacacatggtactctaaaaacgtttccaagctgccacgtgangccagaaaatcataaaattataagaaaaaa

SEQ ID NO: 51883 - DNA, 101 bp, rice(Oryza sativa)
  misc_feature (71): n=t or c
ttttaggaagagcacaatgtattgtttcccatgcggacctttgccaaatgtcatcaatcacaacaagatanctataggcaaaaatttgtgaagcagagcat

SEQ ID NO: 51884 - DNA, 101 bp, rice(Oryza sativa)
  misc_feature (71): n=a or c
cctcttcattgtccaggtaccatagtatgctggtctatgacttttgtcaaactgtaaaagcttctttacangccaaactgaagaggatgtgttagcattag

SEQ ID NO: 51885 - DNA, 101 bp, rice(Oryza sativa)
  misc_feature (71): n=a or g
ggcaccaatgcacttcgtttactcggactggttgtctccaaagaagaatcattctgagaacacagtttcantgactgtaagttgggagctgcagggggcgc

SEQ ID NO: 51886 - DNA, 101 bp, rice(Oryza sativa)
  misc_feature (71): n=a or g
agtcaacattttaacaacatttcgcaacaacagtaattttctgcagttgtccgcagtttctatctcgcatngctttgcttttgtaagtcagaggtgcaaat

SEQ ID NO: 51887 - DNA, 101 bp, rice(Oryza sativa)
  misc_feature (71): n=t or c
agttaatgagagttaattaaaccattttgccgtgctgccgttgctgcggttgttttttcttgcttgtcctncagttggcagcaactgttgcacacccagcg

SEQ ID NO: 51888 - DNA, 101 bp, rice(Oryza sativa)
  misc_feature (71): n=a or g
agatggggggagggtggcgtttttttcgcctaaaacaatttcgcaagcaggtggctatagcgtttgtgaanatggagatactgtctgcaaaaatcattttc

SEQ ID NO: 51889 - DNA, 101 bp, rice(Oryza sativa)
  misc_feature (71): n=a or g
ctcttgtcgacaaaattgtcgaccatttcattaaccggatgggagttctacgaaacctaaattcaataacnggttacaaaaattgtaaatttaatcatagt

SEQ ID NO: 51890 - DNA, 101 bp, rice(Oryza sativa)
  misc_feature (71): n=a or g
taaacaatcgcagaggtggtgagaggatcgctactatgttggtcaaggactagatgtatagtcgcacctcncccggttgtagatgtggtcggaggatcgcc

SEQ ID NO: 51891 - DNA, 101 bp, rice(Oryza sativa)
  misc_feature (71): n=t or g
aggataacactagcaagttgcggactgaaagagataattccactgtgttatataacacatcggaattgggngagcatgtgttaacagtgaaatttggcaag

SEQ ID NO: 51892 - DNA, 101 bp, rice(Oryza sativa)
  misc_feature (71): n=a or c
tgatagctgggacccaactcggctttagccataggtttctatagctataacaaaagacaatgctgcgttgnacccaaaggaaaaaactggaaaattagaag

SEQ ID NO: 51893 - DNA, 101 bp, rice(Oryza sativa)
  misc_feature (71): n=a or g
gcatcgatcgtttttagaagatactactaattccaaccattttcacccctagctagaagaattagtgactncacgtatgtgtcgaggcatttaacacaaga

SEQ ID NO: 51894 - DNA, 101 bp, rice(Oryza sativa)
  misc_feature (71): n=a or g
catcaccacacaaaggagagaggagagctactagtacaatactgggagtataccaggtaaccaacaagaangaaaaaaaaaataatagccaccctatctta

SEQ ID NO: 51895 - DNA, 101 bp, rice(Oryza sativa)
  misc_feature (71): n=t or c
gatttctccaggacaagtttgtgtctcctcacctcatgcagccatattaatgctttttttgtccaatctgntcactgttatgctgttcggtttataaacat

SEQ ID NO: 51896 - DNA, 101 bp, rice(Oryza sativa)
  misc_feature (71): n=a or g
ggaacccacaaacaacattctactgataagcttgtattcattaaacaggtagcatgagacctggaactgcncaggcgacaggaggatccttagccaagcct

SEQ ID NO: 51897 - DNA, 101 bp, rice(Oryza sativa)
  misc_feature (71): n=t or g
tacagctgctgtgcacctctcctgtttgctttgctttatttggcgatatatctccgtccatctcaattggngatactgatacacacggaacgtcttggatc

SEQ ID NO: 51898 - DNA, 101 bp, rice(Oryza sativa)
  misc_feature (71): n=t or c
ttccatggaaaacaatttcatatccagaagatatcaacgtggcaacaatgttctttattctacgtttctantccctacatcccataatataagagataatg

SEQ ID NO: 51899 - DNA, 101 bp, rice(Oryza sativa)
  misc_feature (71): n=a or g
ccaccatggcgcaccccacctcaaggaggcagaggaggtcaagcgtgcggccgcctactacttctgcgggnagtcaggccactcggttgaggaggtctacc

SEQ ID NO: 51900 - DNA, 101 bp, rice(Oryza sativa)
  misc_feature (71): n=t or c
caggtcttcttcaagtgtccaaaggaattaaaaggcccgatcttccactaattcagtgtccttgctgccanaagaagaacatcgtgaagttcactgcaacg

SEQ ID NO: 51901 - DNA, 101 bp, rice(Oryza sativa)
  misc_feature (71): n=t or c
ggggcaagtcccgcctctaatcgggattactcgctagcatgggaaaaaatccctgctgccctccaaattgngatttcctcgttgatgtcatccgctagccg

SEQ ID NO: 51902 - DNA, 101 bp, rice(Oryza sativa)
  misc_feature (71): n=t or c
tagttgtgatttgttacattgatacctcaggtaggttgttgcagtgtgcataattctggcatatgtttgtntctttccaatgagtaacatcttaagcatag

SEQ ID NO: 51903 - DNA, 101 bp, rice(Oryza sativa)
  misc_feature (71): n=t or c
ttcacaactagttacctccatcccaaaaaataacctctagaacgaatctagacaagtgcttgctcggattnatccccagtagttgattctttctatgacga

SEQ ID NO: 51904 - DNA, 101 bp, rice(Oryza sativa)
  misc_feature (71): n=a or c
ccaaatatctatgtttgtaacagtagttggagccaatggtgacatcaaggccagacaggaaaaatcttttnttagctaccaataattttttgtagtggttt

SEQ ID NO: 51905 - DNA, 101 bp, rice(Oryza sativa)
  misc_feature (71): n=a or g
agccagtcctacctctgatcattggccgggatataagtggtgaagttgcagctacagggacttctgtgtcntcctttactattgggcaagaagtgtttggt

SEQ ID NO: 51906 - DNA, 101 bp, rice(Oryza sativa)
  misc_feature (71): n=t or c
tatgcgaaaagctgtgggcctcaatctacagataatccaaaaccgtgggcctgtggttgtctaaatgggcngaacggccaaaaataccccacacccgttga

SEQ ID NO: 51907 - DNA, 101 bp, rice(Oryza sativa)
  misc_feature (71): n=t or c
gcactgttcatgcgtacacgtatgcacagcacacagcctgtttctgcacaggaataattaggacgctaccnaagctacttatctctgaatctctgatatga

SEQ ID NO: 51908 - DNA, 101 bp, rice(Oryza sativa)
  misc_feature (71): n=a or g
gaaaggctgaaatgcgttgggccgagatccattaagcgagtcacctaagtcaaacgaatttgagttatggnccgtaagtgaacttacctgggctgttcttg

SEQ ID NO: 51909 - DNA, 101 bp, rice(Oryza sativa)
  misc_feature (71): n=t or g
tgctcgcgtgacggcggtggcgccgctggtgtacgacccagccttccctaaccattacgtcattgacctcnccggcgtgagcctcggcggccgcgacatcc

SEQ ID NO: 51910 - DNA, 101 bp, rice(Oryza sativa)
  misc_feature (71): n=a or g
agtctcgctcaccttgtagctgctctggaaagcgttgtcggcgtgggtgttgatgccggcggtatggctgnagtggctctcctgtagatgctggctctctc

SEQ ID NO: 51911 - DNA, 101 bp, rice(Oryza sativa)
  misc_feature (71): n=t or c
tactgcgacgaccaccgccagttcctccaccgcgtgcagtgggtgatcctgaggacggacagctacatcgngccggggatcttcctcaacccggcgtacaa

SEQ ID NO: 51912 - DNA, 101 bp, rice(Oryza sativa)
  misc_feature (71): n=a or g
atacattacatgtttttgagatgcgtcagtcatgctctttgaggaatctatacacgtgttacctgttcttnggaataaagtaaagatacttcttttctgaa

SEQ ID NO: 51913 - DNA, 101 bp, rice(Oryza sativa)
  misc_feature (71): n=a or g
ggcgggataaaaattaagaacctgcctgtaagatcccctccccaacagtcctcaattctcaataagtttcngataatatgtaagaatcggcacctagaaca

SEQ ID NO: 51914 - DNA, 101 bp, rice(Oryza sativa)
  misc_feature (71): n=a or g
gggatgagcgggtgttgcccatgttccacgaggtggagaggcatggttggtatggatttggttggtagccnaggctatgggaggcccccctcgccagtctt

SEQ ID NO: 51915 - DNA, 101 bp, rice(Oryza sativa)
  misc_feature (71): n=a or g
cgacgccgctccggccgccgttcctcaccaccgaagcaacaccaagccaatgtacttcgtctgcaagctcncctcgaccccatcgaggttcgactgaagcc

SEQ ID NO: 51916 - DNA, 101 bp, rice(Oryza sativa)
  misc_feature (71): n=t or c
gatgacagagggaacgcgaatggtccatcccatgcctcagatgcctcgtcccatgtctcaagtggttcctnccaaggctctagatgtcgcaacctcacact

SEQ ID NO: 51917 - DNA, 101 bp, rice(Oryza sativa)
  misc_feature (71): n=t or c
ctcacatcgataaataaacttaacctccgtgtcctttcgagctagccgtatatctcatgatgggaattgtnagggtcgatccatttatccactgaacctat

SEQ ID NO: 51918 - DNA, 101 bp, rice(Oryza sativa)
  misc_feature (71): n=t or g
agggctctcccgggaaactccattcaaattcgaactcatccattcgcgccacttctctgacactctcctcnccaccacccgagtcatggtggtacaggtgt

SEQ ID NO: 51919 - DNA, 101 bp, rice(Oryza sativa)
  misc_feature (71): n=a or g
ccctcggttagcaaatacaaaagtaacaagatgaatggggtggataagctttgtagtgttgattgggtctntccatcattccacaccaactatttatggca

SEQ ID NO: 51920 - DNA, 101 bp, rice(Oryza sativa)
  misc_feature (71): n=a or c
tttttcagagacagctagaatcctagagggagatagttcatcttggaacaatttgattaaatatcagaatnataacatattttaactgtgcatatatattt

SEQ ID NO: 51921 - DNA, 101 bp, rice(Oryza sativa)
  misc_feature (71): n=t or g
aaatcgatcactcataatgtgagctataggtacatgtatacgtggtagcttaggtagctccattggattanattacagctgaaacgccattatatgtgaca

SEQ ID NO: 51922 - DNA, 101 bp, rice(Oryza sativa)
  misc_feature (71): n=a or g
ggtcctcgggtgttggtattagtttttcaaccttagcccttaattttagttaaggttgtaagatgaatgangctatataggatccagcattgtttgattct

SEQ ID NO: 51923 - DNA, 101 bp, rice(Oryza sativa)
  misc_feature (71): n=a or c
gcaaatgttacaagttcccttttttgtggcttgagaaacagcaggccagcagcaacattttggtgattttnaccgcagattagtagcaatcataggctcaa

SEQ ID NO: 51924 - DNA, 101 bp, rice(Oryza sativa)
  misc_feature (71): n=t or c
gtttggtccatcggcaagatgaagaaaccattgatacctggcttcgggacataatgatggttctctgcttnaagtctaaaataaaacaactgatttgcata

SEQ ID NO: 51925 - DNA, 101 bp, rice(Oryza sativa)
  misc_feature (71): n=t or g
catcgcccaggcaacgtactacgtacgtctacacctaaacagtattggttttgtttcctccatgcatggcngatcgatgaggctcctctaacataaatcag

SEQ ID NO: 51926 - DNA, 101 bp, rice(Oryza sativa)
  misc_feature (71): n=t or g
tgtagatagcggattctgaagatttatcaaagtccctgtacacatttgaggatgtagtcctccctttgccngggtgatgagcgcttattttatgttttatg

SEQ ID NO: 51927 - DNA, 101 bp, rice(Oryza sativa)
  misc_feature (71): n=t or c
tgaacacggactatgactcatcccatttgaagcaattaattttccctgcgtaatcctacaggcagttcgcnacagtcatgccgacgacgctgatcctgaac

SEQ ID NO: 51928 - DNA, 101 bp, rice(Oryza sativa)
  misc_feature (71): n=a or g
ttgtgagtgactgattcggctagggtttgccggtttggactttgaattgttttcttttgggccttatccanatacctgtagattgggtggtgcgcctgttc

SEQ ID NO: 51929 - DNA, 101 bp, rice(Oryza sativa)
  misc_feature (71): n=a or c
tccatgtgctcacacctctcaaattttatgcaaataactagtttgagaatttttctgccatgacttacttnttaattaatataaatcgacgcaccagccaa

SEQ ID NO: 51930 - DNA, 101 bp, rice(Oryza sativa)
  misc_feature (71): n=a or g
gtgaattgaaaataaagaactacgtgaaggaaattcacatataaaatatgggagtacctatacatttgtcnacaaattttctcttaaaaatttgtcaaatg

SEQ ID NO: 51931 - DNA, 101 bp, rice(Oryza sativa)
  misc_feature (71): n=t or c
gtggcgtgcctcttaaacgttagaggagccgattcccttctgaaatctggttttctaaaggagccctaagnatactagataataaattagtgacctaacat

SEQ ID NO: 51932 - DNA, 101 bp, rice(Oryza sativa)
  misc_feature (71): n=t or g
agggcacgatggtatttaattctttgccacttgtggggggcattattcggagaacaacagagtagcaaatnaatctttttcctgaaaagagctttttcttt

SEQ ID NO: 51933 - DNA, 101 bp, rice(Oryza sativa)
  misc_feature (71): n=t or c
agatgtagctagtcacttccatctcgtcctctgacggaaaccacgtcatgtatcgccttaagatcaccctngtgttgctcaccgcggtcgtcatcgccaat

SEQ ID NO: 51934 - DNA, 101 bp, rice(Oryza sativa)
  misc_feature (71): n=t or g
aaattatcccccattctctaatattggcttttgttaggtagccatacaagctatagctgatgcggctgctncatagattagactctttttgggacggaggg

SEQ ID NO: 51935 - DNA, 101 bp, rice(Oryza sativa)
  misc_feature (71): n=a or g
tgtgatatgtttgcgtgttgagttacagattacatatagcgggttataacttataaaataaagtatacggncgggcaactagtgctgatgtgtcatctagg

SEQ ID NO: 51936 - DNA, 101 bp, rice(Oryza sativa)
  misc_feature (71): n=a or g
aggtgacgtattcctgctgaatcctgcatcacagtttccataatgcgaccaggatgttttgttataggtgntgaaacagaaatcgttcagtaaattaagtc

SEQ ID NO: 51937 - DNA, 101 bp, rice(Oryza sativa)
  misc_feature (71): n=t or c
atatgtgagatatgtgcggtggtgaaccggtaacgtgttcgttaccacatgttaaaacgtctgagtcggangaggtgtgttttatgtagaactcataataa

SEQ ID NO: 51938 - DNA, 101 bp, rice(Oryza sativa)
  misc_feature (71): n=t or c
ctagggcttatgtgcgctactgaaccggcctatattgcagcacgcacgagttcttaacattccattctgtnctaaacactcgtgttgtactggtcttgtca

SEQ ID NO: 51939 - DNA, 101 bp, rice(Oryza sativa)
  misc_feature (71): n=t or c
ttaatgctcaagaaatcaagaaagaaaccatggatgtgatcgatcattggaggaaccaatgcaagaaacgnaagaacatgatgttgggaaaattgatctct

SEQ ID NO: 51940 - DNA, 101 bp, rice(Oryza sativa)
  misc_feature (71): n=t or g
aaaagatgctccggatagcatgttttggaacgtgctggatttcaataatctaacagaactgcaattgttgnggatacaaaagtgtcctcctatatcgttgg

SEQ ID NO: 51941 - DNA, 101 bp, rice(Oryza sativa)
  misc_feature (71): n=t or c
ctaggatttgaaattttgtatatcaagccactagtctagtaggctattgatgagtcagagctatttcctcnatcgtataagattttatttagatttatagt

SEQ ID NO: 51942 - DNA, 101 bp, rice(Oryza sativa)
  misc_feature (71): n=a or g
aactcttctattaccgttaagaaacgtcacggatcgtgttcaatctatgacaattttgtaaatccgtcacnggagttaatccgtgacgctcaatacatgac

SEQ ID NO: 51943 - DNA, 101 bp, rice(Oryza sativa)
  misc_feature (71): n=t or c
cgctgccgccttgcctaccgctcgtactcgcccatcacagccgcgcctgccatcaccagtgcaggatccangctggatccgccgttgcgccgcccgcatcc

SEQ ID NO: 51944 - DNA, 101 bp, rice(Oryza sativa)
  misc_feature (71): n=t or g
tgccatatatttctggagatatggacggcagttgcaacttgcaaggaccagaaaaccacaacaggagggtngcattaaaacaagttggctgtgtttagttc

SEQ ID NO: 51945 - DNA, 101 bp, rice(Oryza sativa)
  misc_feature (71): n=t or c
caatacaaagtaccttcaatacaacacgattatcttgtatgggttgcttcagaagcagaatctccaacagncctaggccttggtttagacatgaggacaga

SEQ ID NO: 51946 - DNA, 101 bp, rice(Oryza sativa)
  misc_feature (71): n=t or c
atgatatctccattgctacttctggggctgcagacaagtatgtcattccccattcatttcattcttatagntcaaaaggcatgatgtgttgtctgtggtat

SEQ ID NO: 51947 - DNA, 101 bp, rice(Oryza sativa)
  misc_feature (71): n=t or g
aactgatctctaatgctttggacctttatgcggttgtcagttttggtggtgtgtaattgtgctactatttntagttttttgttttgtggtggccgcaaaaa

SEQ ID NO: 51948 - DNA, 101 bp, rice(Oryza sativa)
  misc_feature (71): n=t or g
cggtgggagaactaatatggcatgcgaaggcaccatctaaaattcgattcttcatgtggttggccacaaangggcgctgtctaactgctgataatcttcag

SEQ ID NO: 51949 - DNA, 101 bp, rice(Oryza sativa)
  misc_feature (71): n=a or g
atatgctattgaagacattgcgggcataagaaatatcaccagacttgcacagcccatcaattagggcattntagcatacaatattaggatctactcccttc

SEQ ID NO: 51950 - DNA, 101 bp, rice(Oryza sativa)
  misc_feature (71): n=a or g
cacgattaacactaatctacagctaatcattatcttgtgcatgcaaaccaactgattactctcacgtcccnattttcgttcgggattaaaaattatttaat

SEQ ID NO: 51951 - DNA, 101 bp, rice(Oryza sativa)
  misc_feature (71): n=a or g
ttgatgcgtcagccgattatcaggcgtcctcaacccagtcggcatcagctggaccatctgttgctgtatcngctgagttgtctgctgttgaatcgactgaa

SEQ ID NO: 51952 - DNA, 101 bp, rice(Oryza sativa)
  misc_feature (71): n=t or c
attattaagcaagtgtagatttctgtgtgctttgtatcaaactgtaggttcaaagcacatctgcacatggnaagctttcagattcccaaggtaatttactg

SEQ ID NO: 51953 - DNA, 101 bp, rice(Oryza sativa)
  misc_feature (71): n=a or c
gggagttggggactggagggtgctcttgtttagttcgtattttttgtgatcagggcttagcatctttgagnttaacaaaaaaacttgaacttgtatgcgag

SEQ ID NO: 51954 - DNA, 101 bp, rice(Oryza sativa)
  misc_feature (71): n=t or g
aatacacacatatattgtatgcgtgaaatagtacaaagtgtactgtaatatactttcttcagctatttttnatagtcatatttcatcttggtatacagacc

SEQ ID NO: 51955 - DNA, 101 bp, rice(Oryza sativa)
  misc_feature (71): n=a or g
ggccaccttgtagaagccacatgagaagtggccattgggggacacaaggatggtggtggtgtcatcttggntggagattgaggaaccccttgcaagggagc

SEQ ID NO: 51956 - DNA, 101 bp, rice(Oryza sativa)
  misc_feature (71): n=t or g
acaaaaggcagtaaacaacagctgacattggaggtgctgatgcattgagaaagggaaagagattctggtangaattctgtcattgcctattgctatgcatg

SEQ ID NO: 51957 - DNA, 101 bp, rice(Oryza sativa)
  misc_feature (71): n=t or c
tcacggttaaactgacgtagttgacttcagcctcacatgtaccaccgcatatccatgattcgatattactncattaaacaaaaagatcacaaaactaacat

SEQ ID NO: 51958 - DNA, 101 bp, rice(Oryza sativa)
  misc_feature (71): n=a or g
ggaggcggaggcggacggagcgttcgctccgtccgtcgtttttttttaaacttggttagtattttctctgncggctggtatagtgtaaccgccagcgaaaa

SEQ ID NO: 51959 - DNA, 101 bp, rice(Oryza sativa)
  misc_feature (71): n=a or g
aaaataatttagactccttaacaaaaaaagtgcagatcaacgagtaagtccaaccagtgctgttggaccanccatagcaatagtgctgcaatacagtgaaa

SEQ ID NO: 51960 - DNA, 101 bp, rice(Oryza sativa)
  misc_feature (71): n=t or c
cggctcacccacaaggccactagacacgctccacatctaacttccgttgtcatagccttagctcctctagngaggaggagtggcaccccttttttgggatt

SEQ ID NO: 51961 - DNA, 101 bp, rice(Oryza sativa)
  misc_feature (71): n=a or g
tcctgtgatcctgtttcctacaaatagatctttttgttgttctgtcgtttcacctactgatattccgctantctccagtctccacagttcaccatctcccc

SEQ ID NO: 51962 - DNA, 101 bp, rice(Oryza sativa)
  misc_feature (71): n=a or g
ggctattttggctatggataatatttccaagtaaaacaatagtactcgtatgtcccataatgtaatataanaaaaacaagtaaattatataattctaaaag

SEQ ID NO: 51963 - DNA, 101 bp, rice(Oryza sativa)
  misc_feature (71): n=a or g
gaagaaccatcaagcaagttatacagtgcactcataaacctgcactaataacacattagctatccatcacntggaagttgtggaagcacagtaaataagca

SEQ ID NO: 51964 - DNA, 101 bp, rice(Oryza sativa)
  misc_feature (71): n=a or g
tccagctagagtaacagagatgattagatgagttatactggcacatcatatatatttttttgaacacaagncaatgtacttaccattattaatgcaaaaga

SEQ ID NO: 51965 - DNA, 101 bp, rice(Oryza sativa)
  misc_feature (71): n=t or c
cctttttgttttggtgaattggtgtgcttgcgcagcacatgtgtcatttgtttatgcgtctacgacgaaanaaagctgatctgctacgagatctgccggtt

SEQ ID NO: 51966 - DNA, 101 bp, rice(Oryza sativa)
  misc_feature (71): n=a or g
ccccaccctcaacacaacaaagaaaatgcagaccatcatgatttcagagtttcagcgcaattcctaattcncgcgtacgcgcccgcggcgcgcatttttgc

SEQ ID NO: 51967 - DNA, 101 bp, rice(Oryza sativa)
  misc_feature (71): n=a or g
cattactaattttctcgtgggccacccaaacggccaaacctcctcatgactagactcggataggggctacntacatgagaaattaggaggacgagaagaga

SEQ ID NO: 51968 - DNA, 101 bp, rice(Oryza sativa)
  misc_feature (71): n=a or g
acacaacaaaaaaaacaatattttcttctcttgtaggccccatttccactaaaactagaaaatcatgcgcncctggcgcgcatgatttatagcccgtatat

SEQ ID NO: 51969 - DNA, 101 bp, rice(Oryza sativa)
  misc_feature (71): n=a or c
tgtgccttggcttagatattttttctttcttgttcatttcgattccatctacatgcacgagctcaaggatntgtgcggatgtcgtgcgtgttagtttcgtt

SEQ ID NO: 51970 - DNA, 101 bp, rice(Oryza sativa)
  misc_feature (71): n=a or g
gatccttgataacatatttagtggtatgttttcaagtacattcttgttggcttattgattattgattatcntgagcacgtttctcaagttagcatatactt

SEQ ID NO: 51971 - DNA, 101 bp, rice(Oryza sativa)
  misc_feature (71): n=t or c
tatttgatcactgccattttcctttattacttcatacattagttcctgcactagagtctaaaatggcatcnacttttgagtggtatggactatattatact

SEQ ID NO: 51972 - DNA, 101 bp, rice(Oryza sativa)
  misc_feature (71): n=a or c
tagctcgtgctcactgggcggcagctcaagacgaggtcgcaaaaagaaaaaggggaaaatgagaggaaaanatatacggaaactaaccaaaatcaaaataa

SEQ ID NO: 51973 - DNA, 101 bp, rice(Oryza sativa)
  misc_feature (71): n=a or g
cacgagaaggattcgcggtgaatgatgagtgaaaacgaatcaatccctgacaccgcaacatgccaaacgcncacacacgcacaggcacagagataggtggt

SEQ ID NO: 51974 - DNA, 101 bp, rice(Oryza sativa)
  misc_feature (71): n=a or g
ctaactactgttggtgcctccatttcagataagctggccaaccaaagataatcaggaagggccaaaatgantgcagaaagtttcgaagtatcttcctgccc

SEQ ID NO: 51975 - DNA, 101 bp, rice(Oryza sativa)
  misc_feature (71): n=t or g
attggtgtagaaattggtttacaatccaccatcttgaagcgccttaaaagatacttggtgtacttcatttnatgcacaaatgtaccttgcttcatttgttt

SEQ ID NO: 51976 - DNA, 101 bp, rice(Oryza sativa)
  misc_feature (71): n=t or c
ggttgctgctgcgtaacaaaaggggaatggtgaagcaaggtaggagaagattggaaattagtagtctaggntttttttttcatttgtatattagttataag

SEQ ID NO: 51977 - DNA, 101 bp, rice(Oryza sativa)
  misc_feature (71): n=t or c
ttgtctatggtatattattcatgtgctatgtttttactgctctagttgccaacttggcattgtacttgtcngtagtataatctttgcttctgaatggtcgt

SEQ ID NO: 51978 - DNA, 101 bp, rice(Oryza sativa)
  misc_feature (71): n=a or g
tgtagtggtggcggtgaagctaaccctaacatacgcgtgtaatatggaccgtaggattggcagatcgaacngttcagatcgatagacagacccacggttct

SEQ ID NO: 51979 - DNA, 101 bp, rice(Oryza sativa)
  misc_feature (71): n=a or g
taacttcgctacacgaaggtaagcgtcctacgcctatgcagcggagaggcatgctcgcgtgtaccgcacgncccgacgggatgatcgctcgcatttaaagt

SEQ ID NO: 51980 - DNA, 101 bp, rice(Oryza sativa)
  misc_feature (71): n=a or c
aggcagacgcccagaaaacagacaaccacatggataaggacatttattcggctcagcaatcagcattcagntgcagtattcttttgaatgatagggttcct

SEQ ID NO: 51981 - DNA, 101 bp, rice(Oryza sativa)
  misc_feature (71): n=t or g
ttgtctttgccttagcttttgcatggctcaaccttgtctttctcctggatctctctcgcgcggctcgtctngttcctttcctcgccgggggcagccacagc

SEQ ID NO: 51982 - DNA, 101 bp, rice(Oryza sativa)
  misc_feature (71): n=t or c
ttccttatggttttggtgagggttattggcttatcgctattcagtggtaaccgcatggttatcgtgaaaancatgaggttattgttagaagccatgagagg

SEQ ID NO: 51983 - DNA, 101 bp, rice(Oryza sativa)
  misc_feature (71): n=t or c
gcctctaaaacttgttcctctgtgcactattgctgtttcttctgtagtttgatactttgattttgttactncctccgtttcaggttataagacgttttgac

SEQ ID NO: 51984 - DNA, 101 bp, rice(Oryza sativa)
  misc_feature (71): n=a or c
tttatttttttattttccttcagcctacttgtagagtatacagtagatcaagggtagaaggatagagctanaccctagtacttgtagagtacatgtgtttt

SEQ ID NO: 51985 - DNA, 101 bp, rice(Oryza sativa)
  misc_feature (71): n=a or g
gaaataggatatgttccctaacctccaaccacacattgcatagaatcatctccacatcgaaaactttggtncaagtaacaatcaagaaatcctgcgtgaca

SEQ ID NO: 51986 - DNA, 101 bp, rice(Oryza sativa)
  misc_feature (71): n=a or g
tattgcctggctgctggtagtactttctcacaccattgctttagatatgcagactggcttgtattattgcnacaaaatatcaggtgagaaccattagataa

SEQ ID NO: 51987 - DNA, 101 bp, rice(Oryza sativa)
  misc_feature (71): n=a or g
tacgctaaaagtgcttctataagactgccatgaaaaaacagttgatccaggttgctagtttaatcgtggantcatgcatacaacgagaaaatatataaaaa

SEQ ID NO: 51988 - DNA, 101 bp, rice(Oryza sativa)
  misc_feature (71): n=a or c
agtcatacagattgcagtatttgttggaaagcaactttagagcttatagtctatcaacccagaggagtcantaaaggataagcaaagaagtgaaatgttat

SEQ ID NO: 51989 - DNA, 101 bp, rice(Oryza sativa)
  misc_feature (71): n=t or c
aggtggaggatcccaatggcccatgggtacaatatggcctggtttagttccaaaaatataatctttgacanatgcatggatcattaaatatagataaaaat

SEQ ID NO: 51990 - DNA, 101 bp, rice(Oryza sativa)
  misc_feature (71): n=t or g
taatcggcccaagtacacggcaagctcctcaggaggaaaattgagataggaagaagcagcaagagggttanggaaggaacaaggggcgtggtcaccggtgc

SEQ ID NO: 51991 - DNA, 101 bp, rice(Oryza sativa)
  misc_feature (71): n=t or c
caagtgattgacaatattatttggaattcttttgtgcagacctccaggtggcgattaagtgcaagaacggnaacggcgagtacgagagcaaggccactgga

SEQ ID NO: 51992 - DNA, 101 bp, rice(Oryza sativa)
  misc_feature (71): n=t or c
gatccacgcatgcatgcactgtctatcctatgctaattgttcgtggttgtctcgtgatcgttgtaacctgntgctcgtcttgttcagtggttcgatggcca

SEQ ID NO: 51993 - DNA, 101 bp, rice(Oryza sativa)
  misc_feature (71): n=a or g
gatggccggtctgaccggtggtgtgtggctggtcagactggaagagtgcgagcctgagtctgttttcatcnggtctcgggtttccttgcttgggaaggtat

SEQ ID NO: 51994 - DNA, 101 bp, rice(Oryza sativa)
  misc_feature (71): n=a or g
ttatcgagcgatcgaaaatgaagagtgaagcgttaaagctggtttttggccgagtacgcaagatttgccangtgtgacaggccatgtagaaagtagaagaa

SEQ ID NO: 51995 - DNA, 101 bp, rice(Oryza sativa)
  misc_feature (71): n=a or g
ctcattttgatttcctaacaagccaagctgttgtttcagctcgttagcgataaggatccagctcaaactgncttgcatgagccgcttgtgatgtaaacgag

SEQ ID NO: 51996 - DNA, 101 bp, rice(Oryza sativa)
  misc_feature (71): n=a or g
gggcacgtgcatgagcctataatgattctagagtcgttgcttcgaaagatctctggatttgacacgcttcncttttttttgtttgcacggatctcataacg

SEQ ID NO: 51997 - DNA, 101 bp, rice(Oryza sativa)
  misc_feature (71): n=t or c
gccctaagtacgtttttatattctgttaatagatgttagagacaaaaccatttagaataacctgaagcacnataattgtttattagatcagtgtacccatt

SEQ ID NO: 51998 - DNA, 101 bp, rice(Oryza sativa)
  misc_feature (71): n=a or g
ttttcacaggcggagccttacaaggtctgcctatgaaaattaattttgcaggcatagccttatgatgtccncctacgaaaatatgtatatcttcgctggcg

SEQ ID NO: 51999 - DNA, 101 bp, rice(Oryza sativa)
  misc_feature (71): n=a or g
attattccatgaatgacataaccagacattttacaccctgaacgtctcaaactggacgaataacccctaancactatttgtgcggttttaacatgagctga

SEQ ID NO: 52000 - DNA, 101 bp, rice(Oryza sativa)
  misc_feature (71): n=t or c
tctatctatgtttatagtccattaaacttcttacaaatgcttctatattgtcacgtgacttctaagatgtnacatgacactcaaataaattaaagaaattg

SEQ ID NO: 52001 - DNA, 101 bp, rice(Oryza sativa)
  misc_feature (71): n=t or c
atttcccactttttgagagaccatgtaggtactatgaccatggccccgtttagttccaacgtttttttttncaaacttccaactttccatcacatcaaatc

SEQ ID NO: 52002 - DNA, 101 bp, rice(Oryza sativa)
  misc_feature (71): n=t or g
ctctagacccacccgcccctaagccaatctatccctagtttcccctcttctctctctacacctatggctanagaaggagggcaaaggcggagaccgcttgg

SEQ ID NO: 52003 - DNA, 101 bp, rice(Oryza sativa)
  misc_feature (71): n=t or g
cgcgcgtcggctgcgagtttctctggaatctctggaatccctcgtctgaccgaggaagagcggcgggggtnacgagatgtcggggttcggggacgggtacg

SEQ ID NO: 52004 - DNA, 101 bp, rice(Oryza sativa)
  misc_feature (71): n=a or c
aggtatccctctaatccctagtcatcgggccggctctacagtgatgagatagcagacttaaccattcaacnaccgtatattttacagcaatgccatgtatt

SEQ ID NO: 52005 - DNA, 101 bp, rice(Oryza sativa)
  misc_feature (71): n=t or g
ggactgcaatcaaatgttggttacggatttttatttgtttgcaaggagcagcttccagctgcgtgcgtatncatgcataaatttgcagtcacgggatgagg

SEQ ID NO: 52006 - DNA, 101 bp, rice(Oryza sativa)
  misc_feature (71): n=a or c
tgcttttctttgccaacaatgtcttaggtaggaaggttggtgatgagtccatcaatggcgctttctctctntatatatctatctctatctcccatgcattg

SEQ ID NO: 52007 - DNA, 101 bp, rice(Oryza sativa)
  misc_feature (71): n=a or g
agtgctcagctcaaagaaagaaggtggtgggggcttcgaagagtgaataagttcggcattctcgatctcanggcttgactagttgactatgggcctggttg

SEQ ID NO: 52008 - DNA, 101 bp, rice(Oryza sativa)
  misc_feature (71): n=t or c
ctaggcatagaaactttctacgtgaactatctacctagaaacttaccgtataaaaaaattgatatagaaanatagcaattttatagtacttgagaaaaata

SEQ ID NO: 52009 - DNA, 101 bp, rice(Oryza sativa)
  misc_feature (71): n=a or c
agcgaacaattaagatatatgtacattgagcacatttctaaaaaaacagtgacactggatatttcccatcnatcatctctgccgaccatgtcaaaagaata

SEQ ID NO: 52010 - DNA, 101 bp, rice(Oryza sativa)
  misc_feature (71): n=a or g
aatagtactattagttgtttgaactatcgtaatacaaaatgttcatgggagtttctcttctacttcctccntttcagattataaaactctttagcattgcc

SEQ ID NO: 52011 - DNA, 101 bp, rice(Oryza sativa)
  misc_feature (71): n=t or c
atcgtattattatagtcctattcggatgtctaggcaatggctataacccagtgccataagcacagataagnagtggactcagcagccgcagccataaaaga

SEQ ID NO: 52012 - DNA, 101 bp, rice(Oryza sativa)
  misc_feature (71): n=a or g
gatggacgtccactcgagctattagaatccatctccatatataacatggttcttgcgcgatatggtgccantcgaatatcagcaacaggaaaactcaagca

SEQ ID NO: 52013 - DNA, 101 bp, rice(Oryza sativa)
  misc_feature (71): n=a or c
gtgcactgagctcctccacctctccctaaaaagctacgcgcatgtggtgtcggaaaagcacaaaaaaaaanccgtgcaaaaagcacaaaaagcaaaaaaga

SEQ ID NO: 52014 - DNA, 101 bp, rice(Oryza sativa)
  misc_feature (71): n=a or c
aatgtccctctaactttacttaaagaggagactcatcccaaccaaggtattcgtaataggcgagaagtcanatttgcacagctgccatggatcaccaacgc

SEQ ID NO: 52015 - DNA, 101 bp, rice(Oryza sativa)
  misc_feature (71): n=a or g
gattttacagagaacacacctgcatggttctccaaccctcgctcaaaagaccttctcctcgcttctcctcncctccggttcgatccgcccaagttccaggg

SEQ ID NO: 52016 - DNA, 101 bp, rice(Oryza sativa)
  misc_feature (71): n=a or g
actcgagctgttaaaacagtttccccatgcaccagcagccacaatgctatataaaccgcagccaaaatccnacacccctgcacctctccatttcttcctcc

SEQ ID NO: 52017 - DNA, 101 bp, rice(Oryza sativa)
  misc_feature (71): n=a or g
ggcggcggcaatactgcctctccctcaactgagttgatctgaaccttggtctgcatgtagtaccgacctgntgaggtagtaggtgacttcgagggagcgca

SEQ ID NO: 52018 - DNA, 101 bp, rice(Oryza sativa)
  misc_feature (71): n=t or c
ctaccccataaccaaaatcaaatggccggactaaaccgactgcatgtaacacaacagtgtctgcacaattnatatatgacctaacttctagtatcacttat

SEQ ID NO: 52019 - DNA, 101 bp, rice(Oryza sativa)
  misc_feature (71): n=a or g
gatttgtactaggtcttaaatctcccatgtgtgcaattcgttgtgcgtgcaatcatgcaaatgtatcattntctgttgcttcccccattcccaacttcttt

SEQ ID NO: 52020 - DNA, 101 bp, rice(Oryza sativa)
  misc_feature (71): n=t or c
gtgtgtcacccctttttgcagggttagtctcaaaatttgttaaactatatcctgatctgggatttgatccngaggcctcgctgttgatgaatgtttggcaa

SEQ ID NO: 52021 - DNA, 101 bp, rice(Oryza sativa)
  misc_feature (71): n=a or g
tgataatgaggaagagagagcggggatgatgatgaagtgaggctgcgtggaggagaccactagctgcgtcngcaaatgagacaatgtggggatgaccactg

SEQ ID NO: 52022 - DNA, 101 bp, rice(Oryza sativa)
  misc_feature (71): n=a or g
ggatttgacacgtcctatgggtttctttataccgtcactccatattagttgcagggcggtacaaatccctntgcacaactcaccagcgatgtgagagacgt

SEQ ID NO: 52023 - DNA, 101 bp, rice(Oryza sativa)
  misc_feature (71): n=a or g
ctgcttaatgtcccatgcgatgattggatgtcttcctcgttgaaacttagctgtgttcgcacagaacactnctacaaaagtgatttttctgtacgaggccc

SEQ ID NO: 52024 - DNA, 101 bp, rice(Oryza sativa)
  misc_feature (71): n=a or c
ccaacaatctccatgatccgattgcttttacagttcatcagccatcgctatcgcaaattcgcgagtgctcngccgcgcgtacggtctgtcgtgtgtgtggt

SEQ ID NO: 52025 - DNA, 101 bp, rice(Oryza sativa)
  misc_feature (71): n=a or g
agatgagaataatattggcagcatgaactaattgacagtaagtgcttcgatatgatgtggttctatatcantcctggggcctgtattagtatcatagatga

SEQ ID NO: 52026 - DNA, 101 bp, rice(Oryza sativa)
  misc_feature (71): n=a or g
ggatgtgctaggaggagacgctaggttgacttggtataagaggaaaataggcacccaaattcgtttcgacnaggattcgaacttggaaggtgtaagcgtac

SEQ ID NO: 52027 - DNA, 101 bp, rice(Oryza sativa)
  misc_feature (71): n=t or c
aatattctgatattctcatttctgggaacttagtgttcccttgtcaacctagctaccattgtaagggatgncaaatgtctattttttttgctatcctttac

SEQ ID NO: 52028 - DNA, 101 bp, rice(Oryza sativa)
  misc_feature (71): n=t or c
tttgttccatgtcatcaaatttatttgcacgataatagcgagagcccactagtaaagaccatcgtacatancctaacgcaaccagctctttccatgggctc

SEQ ID NO: 52029 - DNA, 101 bp, rice(Oryza sativa)
  misc_feature (71): n=a or g
atttcatcgataaacgaaagatagaacacgagacaatcctagtgatagtgagtacagacaataaagacacnaacgctaagacgaattttaccgttgaacac

SEQ ID NO: 52030 - DNA, 101 bp, rice(Oryza sativa)
  misc_feature (71): n=t or c
gcctccatcactctccctcttggatctttttctgttttgctctacctcctgtacgatctctctctctctcntgtacgatctctctctcttgaatctttttt

SEQ ID NO: 52031 - DNA, 101 bp, rice(Oryza sativa)
  misc_feature (71): n=t or c
tggacatttgtcatctaaactgaatgaatatagactcaaacaggtctgcgattcggagtatataccctggncggttccgtgcttgcccggcttctccactg

SEQ ID NO: 52032 - DNA, 101 bp, rice(Oryza sativa)
  misc_feature (71): n=a or g
aaacattcaagcacacactttctagtttcgcccctttctttaaagagttgagacacatgtcttatgaaganttacgcatacggtgaattcttagttcatag

SEQ ID NO: 52033 - DNA, 101 bp, rice(Oryza sativa)
  misc_feature (71): n=t or c
taccgcctctctctctccccccctatatatatttaaaggccatgttgggccaactttaaacccatctgacnacggtacatttaaagcccatcggactattc

SEQ ID NO: 52034 - DNA, 101 bp, rice(Oryza sativa)
  misc_feature (71): n=t or c
ataagcttgcagagttatatatggcaagagttgtatgtttacatggtgttccaaggaaaatagtgtcaganagaggtagtcagtttacttcaaagttttgg

SEQ ID NO: 52035 - DNA, 101 bp, rice(Oryza sativa)
  misc_feature (71): n=t or c
aattctggcatataacatgaagtatgcttaaagcgccaatgggcatgggcattaaaatgtttaagttgtcnataggtacaatgacacacctctgcagagca

SEQ ID NO: 52036 - DNA, 101 bp, rice(Oryza sativa)
  misc_feature (71): n=a or g
aaatggccgatatgaaaaacctttttttctagtagtgaaataatgtgataactgtaataatgagcagtganccgagcattgaacagccccgagggaaaaat

SEQ ID NO: 52037 - DNA, 101 bp, rice(Oryza sativa)
  misc_feature (71): n=t or c
tatgtgcttgaactgttattaattacctcctctggaaaaaatgcattggtgacgtccaaggatacttagcntcttgaggtatttgtttcttaagttttttc

SEQ ID NO: 52038 - DNA, 101 bp, rice(Oryza sativa)
  misc_feature (71): n=a or g
agcttttaaatatatgcttttttaaatagagtaatatatcatatgcagacaaggttctcttttacacttcntacacaccaactagcaaatattacaaaaaa

SEQ ID NO: 52039 - DNA, 101 bp, rice(Oryza sativa)
  misc_feature (71): n=t or c
gttttccctacaagcgaaatactacataatattcgagtactagaagcagtgatcggtcgatgcaacagganatacacacacaagcaaacagccatgaggtc

SEQ ID NO: 52040 - DNA, 101 bp, rice(Oryza sativa)
  misc_feature (71): n=t or c
cctgacattaaaaagtgtccgaactacggagagacactaacgattacactagaaaagtttggtacattctngatggaaagaaaccatcgtatacaatcaaa

SEQ ID NO: 52041 - DNA, 101 bp, rice(Oryza sativa)
  misc_feature (71): n=t or c
aaactaaaaccgatgaaatcaaagcaaatgagtgaaggggcaggaaatctcatgggctaaaatggcatagntgaccagaacagttgttagtcagatcggtc

SEQ ID NO: 52042 - DNA, 101 bp, rice(Oryza sativa)
  misc_feature (71): n=t or g
caccatctttctcggctcttttggcgtaatgctagctagtagctcttcggtttctgtggcaaagattgggntcctgctggtaatatggtaggtgcagggac

SEQ ID NO: 52043 - DNA, 101 bp, rice(Oryza sativa)
  misc_feature (71): n=a or g
gtacgtcctaattccccaattctgtgtagtttcttactttcttttgtagatgaactatagctagccaagtngccatggtgatcgatgatgaactgagaaga

SEQ ID NO: 52044 - DNA, 101 bp, rice(Oryza sativa)
  misc_feature (71): n=a or g
aatttttactaccctatactactttcacaaacggtatagctgacccaacgcagcagctgcccgatggaagnctcccatcggttgccattttacccaaaatg

SEQ ID NO: 52045 - DNA, 101 bp, rice(Oryza sativa)
  misc_feature (71): n=a or g
atcgataacttcgagttcagttccaatgctatttcttcagaggcaactgtactaatcctgaagtgtgtccnttacgtgagcccatgtgatgatttcataac

SEQ ID NO: 52046 - DNA, 101 bp, rice(Oryza sativa)
  misc_feature (71): n=a or g
gatctgcagctgatcagactactactgcacgtgcaatccattaattaattcgtttcgatcctgattccttnatcagtttcattcctcgatatcatataacc

SEQ ID NO: 52047 - DNA, 101 bp, rice(Oryza sativa)
  misc_feature (71): n=t or c
catgccttacagcaaactacacaatttgttacagaggtataccaagtggttcctagtaaaccatactgctngttactataattcaacatgacaaatttggt

SEQ ID NO: 52048 - DNA, 101 bp, rice(Oryza sativa)
  misc_feature (71): n=t or c
ttgccagaagaatttcctatacaacaaaatatcaaatgcaacaaaatatcaaatgctctctcaagaacacntaagagtttagggaatcaagcgagacacat

SEQ ID NO: 52049 - DNA, 101 bp, rice(Oryza sativa)
  misc_feature (71): n=a or g
ctatctcatcaaatgttctttctaatgattatctccatacttgatgtttaactatggaagcttgtccgacnagttatgctagtcatgttttattgatgatc

SEQ ID NO: 52050 - DNA, 101 bp, rice(Oryza sativa)
  misc_feature (71): n=t or g
gtctggaaagcgggtcatggcaagggacgagtggtcgagatggtccatcacgaagtagtctatgccaccancgcataaggcctgcaggagtatagctttgt

SEQ ID NO: 52051 - DNA, 101 bp, rice(Oryza sativa)
  misc_feature (71): n=a or g
tgaatatatcgcattcggcatctatactcctgtggtaagcctaccaaatgacacctgcagcatatcatgtnaggacagttatttgagatgtacacttactg

SEQ ID NO: 52052 - DNA, 101 bp, rice(Oryza sativa)
  misc_feature (71): n=a or g
ggaaagagaatgcaatgattcccatgttatggagcctgaaaaagtgaagctaaggattattacctgagaangggtctagccaaagataaacaacagtactt

SEQ ID NO: 52053 - DNA, 101 bp, rice(Oryza sativa)
  misc_feature (71): n=t or c
taaattcgtctccgaaaagtttccgaccgattctggtttccgacggacagtagcctttgcatattcgattntgtttccgagaaaaaaaaaatccaaatttg

SEQ ID NO: 52054 - DNA, 101 bp, rice(Oryza sativa)
  misc_feature (71): n=t or c
cgaggagacgcggccgtacggatcgtgcccgtgtacccgtgtactccctccgtcaatgcaaaccgtggttnctgtgtacgtttgattgttcgttttatatg

SEQ ID NO: 52055 - DNA, 101 bp, rice(Oryza sativa)
  misc_feature (71): n=t or c
tccttactgattgtaaccaatatgcaaaatttcccacaaaattcacggtggccacctttacccactgaccngaaggtatcccataaacatcgaaatagact

SEQ ID NO: 52056 - DNA, 101 bp, rice(Oryza sativa)
  misc_feature (71): n=t or c
tgaaacaaatctctcaccccggatcacctgaaatgcatccctaacacatgatttaagacacggaaactaanagcacatctttgatctcactaaagtcatgt

SEQ ID NO: 52057 - DNA, 101 bp, rice(Oryza sativa)
  misc_feature (71): n=a or g
taagataataaattgcctatataagccactgatctatgctttctgttgccgtttagtgaacagttgttctnctgcacacaccattaacccgactccagtag

SEQ ID NO: 52058 - DNA, 101 bp, rice(Oryza sativa)
  misc_feature (71): n=a or g
atcgatcgatggacagacagtgtgtagtggagacgctattaacccaacccacacacaaaagccgcaaaggncgatgccacacacactccgtcccaacaagc

SEQ ID NO: 52059 - DNA, 101 bp, rice(Oryza sativa)
  misc_feature (71): n=t or g
ttgtgttttctgtcaacacgcttttggcacacctggtgggacatttaagaagtcagccaacaattcttccncatggccgagaaaccaccaccatccccagc

SEQ ID NO: 52060 - DNA, 101 bp, rice(Oryza sativa)
  misc_feature (71): n=t or c
gatctttctaaaactgtcaaaaaatttagatcccagcgacctggaatggtccaaacagaggtatgtgtggntctttatttctctgcctctgctacaaaatc

SEQ ID NO: 52061 - DNA, 101 bp, rice(Oryza sativa)
  misc_feature (71): n=a or c
aagcatgttcattaatattactgtacaccgttgctgctactgtcctgtctacatgcatatgactctgctgnttcctaagaatgataattaattactaaata

SEQ ID NO: 52062 - DNA, 101 bp, rice(Oryza sativa)
  misc_feature (71): n=t or c
gtcaatgatgagaaaaaaaagagtaacgagtgttacaaggcagcaaggtgactgcttgtaaatttcttcantctgcagtaaataatcatgccttagtgttt

SEQ ID NO: 52063 - DNA, 101 bp, rice(Oryza sativa)
  misc_feature (71): n=a or g
cagcaaaatctccacgaaatggaatgattgaaacctgagatagatgacaaaatataaggtaagattggccngtataaaaatcgatagcatacaagctagcc

SEQ ID NO: 52064 - DNA, 101 bp, rice(Oryza sativa)
  misc_feature (71): n=a or g
tctctaataacgagctaaaacatcatctcaactcattaagaaatacaacaagccaaaccgagccaaccacnagttgagcgagttaactagttacgagcttt

SEQ ID NO: 52065 - DNA, 101 bp, rice(Oryza sativa)
  misc_feature (71): n=a or g
atggtggacagtggtgaagttgtgggtacatgactttaactcaaatcatgatgtttacaaatacgcctgcncatgtttagttggtgtagaggctttaagtt

SEQ ID NO: 52066 - DNA, 101 bp, rice(Oryza sativa)
  misc_feature (71): n=a or c
ctatgttagttaaaacactgcaaacttgattagtcttgtttagttcacccattcacattacttgcaggctngcagtgtacaatttatgctgactcttcatt

SEQ ID NO: 52067 - DNA, 101 bp, rice(Oryza sativa)
  misc_feature (71): n=t or c
ctaagaaaaataatggtcaggacaaggaacatgcacaacaatcaggccatcagacaatctatacaatcatnacagttttactataaattctgccacatctt

SEQ ID NO: 52068 - DNA, 101 bp, rice(Oryza sativa)
  misc_feature (71): n=a or g
atacgacgctactccgtcagataattcactggcagattatagacaattcaagagggaggtttggccgtgcnggagtgtttctttaccgacacatgcatcgg

SEQ ID NO: 52069 - DNA, 101 bp, rice(Oryza sativa)
  misc_feature (71): n=a or g
catgttttggaggaactagccttctcatgttcactaccctctcaaccatcttattacccatttgaacaggnttgacactgtcaccactattaagatgtgat

SEQ ID NO: 52070 - DNA, 101 bp, rice(Oryza sativa)
  misc_feature (71): n=a or g
cagacgggctggtggaagtcgacatctccgcaggcggaagcttggccaaagggagagtcgcctcgagatcnccttgcgcaccgaggggatcgccggagaga

SEQ ID NO: 52071 - DNA, 101 bp, rice(Oryza sativa)
  misc_feature (71): n=a or g
atgatacatcagatttgctacgctgcatagatcttgacggtttcttggcaaatgggctcagaaatcgtagntgcaaagcataacgaagagcacctccagct

SEQ ID NO: 52072 - DNA, 101 bp, rice(Oryza sativa)
  misc_feature (71): n=a or c
caatgccagcttcacatatggcattatctgctgtcggcaaatttgaaagcaaatgtattggtcgtaggagnagtctttgatagcttacgttgatgattgct

SEQ ID NO: 52073 - DNA, 101 bp, rice(Oryza sativa)
  misc_feature (71): n=a or c
tagccagttaaaacttttggatatgagtgttatttggattatgtgcatcttaactagctatatacatacgncgaaagtgatctcgagagtatcaacttgat

SEQ ID NO: 52074 - DNA, 101 bp, rice(Oryza sativa)
  misc_feature (71): n=t or c
agtagtactacagtacttcactggttccattggacacaagctctatgtagtgttggaaggtacaaatcacntgattaagtgatatcattaataacctctcc

SEQ ID NO: 52075 - DNA, 101 bp, rice(Oryza sativa)
  misc_feature (71): n=t or g
agatcaagtaacggccccatccaagaaaaagtgataatactaaagaatccagcatctgtgaaagctgatcnactgcttgtggccttagacgaggaagaagc

SEQ ID NO: 52076 - DNA, 101 bp, rice(Oryza sativa)
  misc_feature (71): n=t or c
tccggcggcggtggccgcgacaagagccacatcaaatgtttcaactacgaagagttcggccactactcaangcagtgcccacatccgaagaaaaagaaagc

SEQ ID NO: 52077 - DNA, 101 bp, rice(Oryza sativa)
  misc_feature (71): n=t or c
cgatccatcacaatactttgtaatttcatatactctcaacatgattgcaagctctgcatcttatgctcagnaatcataaggcaattattacatttaagaag

SEQ ID NO: 52078 - DNA, 101 bp, rice(Oryza sativa)
  misc_feature (71): n=t or c
aaggaaaaactttttgaaaggaaaaaagtgggatgctaggaaggaacttagtagtggcgtagctaggattnagagtaaaagtgatccatctatatatagta

SEQ ID NO: 52079 - DNA, 101 bp, rice(Oryza sativa)
  misc_feature (71): n=t or c
cggaaagaacagacacagaaaataatcaaatcgagcaacctagctcccaagcaaagcataatgcgcccccnctcccccaaattaacaagaaccctagcagc

SEQ ID NO: 52080 - DNA, 101 bp, rice(Oryza sativa)
  misc_feature (71): n=t or c
tgccctgaattgaagatatatatggaccccccccttggtgagtgagtttgtgtcatatgtctttctttganatggtaggtttatcattcacatatagcttc

SEQ ID NO: 52081 - DNA, 101 bp, rice(Oryza sativa)
  misc_feature (71): n=a or g
tttttaagagattatagcggctgtagtttctcctatattatagcggctgtagtttctaccctgattttganattatgtaatcgtagaatccataaaacgaa

SEQ ID NO: 52082 - DNA, 101 bp, rice(Oryza sativa)
  misc_feature (71): n=t or c
ataaagggggaaatagttttgtagtgtctgataacatgattatatttgtatactaactgttgtactccctncgttccgtttcaggttataagacgttttga

SEQ ID NO: 52083 - DNA, 101 bp, rice(Oryza sativa)
  misc_feature (71): n=t or c
gagggtttttgagacttcaggcactaaagcagaatacaaacctggaagttcatcagagtcactaacagcanaatgattcatatcttatacgactttggttg

SEQ ID NO: 52084 - DNA, 101 bp, rice(Oryza sativa)
  misc_feature (71): n=a or c
ctccggagcggtccaagggctccagaggtagtcaaggcttccgaggctgtccaagggcctcagaagaaacntgggctttgagagccctgggtgtgaaacag

SEQ ID NO: 52085 - DNA, 101 bp, rice(Oryza sativa)
  misc_feature (71): n=a or g
ctgcaaaagaaggctgcatctgtgtaagggtgaggagtcaattctgccctgctaggcaaggcgagcaagcnagcgcgtgttccccctcttctctccaccac

SEQ ID NO: 52086 - DNA, 101 bp, rice(Oryza sativa)
  misc_feature (71): n=t or c
tactgcacttgccattggaggatctatatatgtttacctctggccgtttgcccttgttggttgtcaatacncgacaccgacgactgacctatgtctaggtt

SEQ ID NO: 52087 - DNA, 101 bp, rice(Oryza sativa)
  misc_feature (71): n=a or g
tgtatgcttcatcaattgtccagatctagtagaaatgatgttgttttatttagttgggtagttgggagttngtatcttgtggatgttttttcatcatgttg

SEQ ID NO: 52088 - DNA, 101 bp, rice(Oryza sativa)
  misc_feature (71): n=a or g
gttttggtttattagggcaaccaatggggctcgggagattttggaagtaactggttgttagtcaacttttnaaaatatataaaatctgggtttctttaact

SEQ ID NO: 52089 - DNA, 101 bp, rice(Oryza sativa)
  misc_feature (71): n=t or g
tgtgcttaaaatactatactgtgtaatgtccgaaatttatattcatgcgttagatgtttcactttcacatncacatgcacttctgttgaatgtgttgttaa

SEQ ID NO: 52090 - DNA, 101 bp, rice(Oryza sativa)
  misc_feature (71): n=a or g
gagaaatagcaaaaatcttgaatgaaatggatgaacgtgatgacaaattgaatttaagtggcctcaaaacnaaaaactgaattgtacatgagaattatatt

SEQ ID NO: 52091 - DNA, 101 bp, rice(Oryza sativa)
  misc_feature (71): n=a or g
cggcaatctgccggggtaccaaaatagtgctgatccgctgatccatggatcgcacgtcgcaacaatcatantgcgagatatagcccttagcccttgatctt

SEQ ID NO: 52092 - DNA, 101 bp, rice(Oryza sativa)
  misc_feature (71): n=t or c
tttactaccaacattattactcctgagaatccaggcttttgttgagccttgaaatcacagactattgtgcnttgctgagataaagaagggttcaaacccct

SEQ ID NO: 52093 - DNA, 101 bp, rice(Oryza sativa)
  misc_feature (71): n=t or g
tattggataatttgtcatcttcgatttgtttcaagattcttatggtttgactgttaagagagaaatgaatnttaagttgcttaattaaatactagccctgt

SEQ ID NO: 52094 - DNA, 101 bp, rice(Oryza sativa)
  misc_feature (71): n=a or g
tgaatattgagtcaaattagccacgtaggcgccacatcagcgctgaagggacttattttgcactggttttnacatttgaaggcatgttgtatctggttttc

SEQ ID NO: 52095 - DNA, 101 bp, rice(Oryza sativa)
  misc_feature (71): n=a or g
aaacccatacgggttacaatgaaaaaataaataatcactacaagggaactcatatttagtctcgggttacnaatcgggacgtccaattcgagactggttga

SEQ ID NO: 52096 - DNA, 101 bp, rice(Oryza sativa)
  misc_feature (71): n=t or c
tcggcttcatcttcagttgccttgtacctgcttcagtcatcttcctggctttgcagaagccttggaaaggncggcctctgcccaacacacaggttgattta

SEQ ID NO: 52097 - DNA, 101 bp, rice(Oryza sativa)
  misc_feature (71): n=t or c
ggaactcaaacggacagccctccgagaaatgataccagtaatgacccagggtccagttctcctgttaaagnacaaaagactactcgtccccgaccggaaat

SEQ ID NO: 52098 - DNA, 101 bp, rice(Oryza sativa)
  misc_feature (71): n=a or g
tatcctcactcaaaggttgcgctacaatgatgaggctagctttcagaaaaccatcaatgatgtttgtgtgngatgatatagttcatcacagtagtcacaac

SEQ ID NO: 52099 - DNA, 101 bp, rice(Oryza sativa)
  misc_feature (71): n=a or c
tgaacttcagtagtatccatccatttcctcagttgatcagtgcataatatttttctttgatggaaatgatntcatagtaaacatcatccattgtcggtcga

SEQ ID NO: 52100 - DNA, 101 bp, rice(Oryza sativa)
  misc_feature (71): n=a or g
tcaatcacagttagatatgtgttatttttcattttcgtgatcacatcaattgtttgtctgcataagccagnacatcacataagcgatgtggcaaccaatca

SEQ ID NO: 52101 - DNA, 101 bp, rice(Oryza sativa)
  misc_feature (71): n=t or c
atcacaatggtatttatattacttttcaaaagggaaatgctacgtaacggtatcgcgttcggacgggatgnattagatatcttacatgtatcattccgtcc

SEQ ID NO: 52102 - DNA, 101 bp, rice(Oryza sativa)
  misc_feature (71): n=t or c
actccatcatagatagcttctgtccatggatcatatgtgcctcaacctgctattggctgtttgtttgtaanggagcttcaggtcacatagactcaaacttg

SEQ ID NO: 52103 - DNA, 101 bp, rice(Oryza sativa)
  misc_feature (71): n=a or g
cattaaccaggtatggcttgagctaaaataaggttgttgttgcacacttgcactgatcaaatggtttcctngttggcatagtcgcatagatgttcattggc

SEQ ID NO: 52104 - DNA, 101 bp, rice(Oryza sativa)
  misc_feature (71): n=t or g
tgggtgtggtccggtagtagcaggcgtagaggatgagctggatggcaccgaagatggcaccgaggccgttngggatggtcacatagatgtcgaagcggatg

SEQ ID NO: 52105 - DNA, 101 bp, rice(Oryza sativa)
  misc_feature (71): n=t or c
ctctagtcacaaaaggaagtaattttgtaccatttaaaatcaatgggacaggactttgactatttaattcntttgaataaatataatgttgtgatcaaagc

SEQ ID NO: 52106 - DNA, 101 bp, rice(Oryza sativa)
  misc_feature (71): n=t or c
gttgggatacgggatggaggcaatgaaatacaacaatatcttgattgtaggtgtgtaacaccttgtgaagntgcatggcgcctactgcaatttgacatcca

SEQ ID NO: 52107 - DNA, 101 bp, rice(Oryza sativa)
  misc_feature (71): n=t or c
agctctcctgtacactgaatggatatggacaagggccaattcctggatttgatagggtgcttgaaatatgngtggctattcagaataaagacatgcatcat

SEQ ID NO: 52108 - DNA, 101 bp, rice(Oryza sativa)
  misc_feature (71): n=a or g
tgagaagaaattcatgcaagtcatactctcacagtatctttactactatactataaaagataataatggtngtggtggttccgtcaccagcccacaaccac

SEQ ID NO: 52109 - DNA, 101 bp, rice(Oryza sativa)
  misc_feature (71): n=t or c
acaaactttcatatagaaagatagatgaaggatcacacatgctgacaggacgtctcccagtccatcttctntatatacaccttggttatttcgaaaccact

SEQ ID NO: 52110 - DNA, 101 bp, rice(Oryza sativa)
  misc_feature (71): n=t or c
gcggtaaataattatacaatgcaataaactttgtgtcaatgggagcatgagactgactggaccaaacagcncattctcttcttcagttggtgcgttctgta

SEQ ID NO: 52111 - DNA, 101 bp, rice(Oryza sativa)
  misc_feature (71): n=t or c
gtctcgagcacaggaacgtctgagttgatgacggggacaatgttgtcatccttctccttcatcagctccanatccagctgcagatcaatcaacgccccaat

SEQ ID NO: 52112 - DNA, 101 bp, rice(Oryza sativa)
  misc_feature (71): n=a or c
caaaagataggtaggtagaggaggtagagtgacaaatctagcgtgtgaggggtaaaggtagagtggagatntagagcaggggcagctttagaggggttggg

SEQ ID NO: 52113 - DNA, 101 bp, rice(Oryza sativa)
  misc_feature (71): n=t or c
cttgagaagcgaccattggtagaaaaggaaatggtttcttcaaagcaagcatatagacctccccacccatnactgaaactgggtagacctaatttaatttt

SEQ ID NO: 52114 - DNA, 101 bp, rice(Oryza sativa)
  misc_feature (71): n=a or g
acctgcatgactatatggacttgagataacctgaagatgacttttggctgtattgcaaccaaaaaaggagntcagtatcacaagaaaataagccaggtttg

SEQ ID NO: 52115 - DNA, 101 bp, rice(Oryza sativa)
  misc_feature (71): n=a or g
aatgcatcagctcacgtcaagccgactttttttttattcgtggattctcaaagatgcaggttcctaaactngcatctatttctcctccatatcagtgccga

SEQ ID NO: 52116 - DNA, 101 bp, rice(Oryza sativa)
  misc_feature (71): n=a or g
ccctagcgccggccagccatcacttggtggtggctgtggcggtgatgaagccgattgtttgccccctctgntgagttgtcttttcgcttgatgaactttta

SEQ ID NO: 52117 - DNA, 101 bp, rice(Oryza sativa)
  misc_feature (71): n=a or g
ctttaaaaaaaaacttaaactgcttatattcgtatattataatattagtgtctaagtaaattactctctcnttctcaaattgatcatcctataatagaatt

SEQ ID NO: 52118 - DNA, 101 bp, rice(Oryza sativa)
  misc_feature (71): n=t or c
cacttcatttatttaagtatctaaaagtgaagcttcatactatcattctactaccgtacccaatgccactnccacctgctatgtccacctgttctccaggc

SEQ ID NO: 52119 - DNA, 101 bp, rice(Oryza sativa)
  misc_feature (71): n=t or c
tcactgggtgttggattatttgcatttattattttttgcaaaattcagctcgaatcaatgctagtagctcnacaatgacaataatttctgttgtctttggt

SEQ ID NO: 52120 - DNA, 101 bp, rice(Oryza sativa)
  misc_feature (71): n=a or g
tcgattggaggtggggtacttgggagaaatccccgacaagtcccaacgggattcacgcctatatgccattntgattttgaccatttagctaccttactgga

SEQ ID NO: 52121 - DNA, 101 bp, rice(Oryza sativa)
  misc_feature (71): n=a or g
ggacaaagatcagatcaacacctccacgtaggtgctacgttagtgaatcagccttccaaaaccattgaggnagtcaaattgcacccgttttatagttgggg

SEQ ID NO: 52122 - DNA, 101 bp, rice(Oryza sativa)
  misc_feature (71): n=a or g
ttgagattaaaaaatacagattacagatcatcttagggaggacgatagagtttccttccaggaggaaacgnccactttgtcctaaacactctgtgctagca

SEQ ID NO: 52123 - DNA, 101 bp, rice(Oryza sativa)
  misc_feature (71): n=a or g
aatttttgaaaagatcaatttgtcaaaaaaggatgaaatagtgtcttcttgaattcaagatctatatattntggactagggttggtaatgggatggaacag

SEQ ID NO: 52124 - DNA, 101 bp, rice(Oryza sativa)
  misc_feature (71): n=t or g
tacactgttcggtgaggatatatatacacaactgaatgcatgtttcgaaccctgcatgtttgaacagaccncgttcgaagtcccgaggtatgaatttcgtg

SEQ ID NO: 52125 - DNA, 101 bp, rice(Oryza sativa)
  misc_feature (71): n=t or c
attaattcagccggcaataatcaatcggaaagccacaagaaaaaaaaaagggaaccgtcctaatccacaangcccagcacaccgcaacgctcgccgctccg

SEQ ID NO: 52126 - DNA, 101 bp, rice(Oryza sativa)
  misc_feature (71): n=a or g
atatagaatcatacttagtgtggagttatggactaacaattaataatattgagatgcagttggtgtatcgngcgcaacggtgaatcaagtctggcaggtac

SEQ ID NO: 52127 - DNA, 101 bp, rice(Oryza sativa)
  misc_feature (71): n=t or g
ttagcatagctactttgcttttgcttgctctggttgaggtgccatcaaatatattcttgcactagaggctntatatatggcggattgagatcctccgacgt

SEQ ID NO: 52128 - DNA, 101 bp, rice(Oryza sativa)
  misc_feature (71): n=a or g
acatcgttagtaaaaaaatattttcaataaaattggcgagggtagcatgaagcggcgccatggcagcgtgncttctttgtcaaccttgcaaagagtagtcg

SEQ ID NO: 52129 - DNA, 101 bp, rice(Oryza sativa)
  misc_feature (71): n=t or c
tgtctttccttggctgccaaatctcttttgcacaaagctattgctggttgtcaactgtgttgactttgcanggttcggctaccttggtttcgtgctgtgct

SEQ ID NO: 52130 - DNA, 101 bp, rice(Oryza sativa)
  misc_feature (71): n=a or c
atttaaaacagcgaaataagttctctaagtttgtaatggacaaacctctcagatgatcacatagactgccnctaggcatgtactcatagaccagtgctaaa

SEQ ID NO: 52131 - DNA, 101 bp, rice(Oryza sativa)
  misc_feature (71): n=a or g
aattcaagaaagaagaagagaaaaacttggagaaccggattccctatgaagcctggttcggcaagaagccngcgatgggacatctgcgcacattcgtctgc

SEQ ID NO: 52132 - DNA, 101 bp, rice(Oryza sativa)
  misc_feature (71): n=a or g
agcggaatgctgaggtaggtgcaaggaaaataaaaaatcgagcaaggaaagcaaggctgaaccagttccangtccttagccgagcaacagatcggagtaac

SEQ ID NO: 52133 - DNA, 101 bp, rice(Oryza sativa)
  misc_feature (71): n=t or c
cttgctatgttcccaatggacggattctcaccacgtggagcgtgttgtctagcatgttgcctaggatcganttctgctgtcacatgggcaggtgcactatc

SEQ ID NO: 52134 - DNA, 101 bp, rice(Oryza sativa)
  misc_feature (71): n=t or c
atgtcatctaaacgaaagttgccttagcaacgagaaagaagattaagttcacggatcggctacttccaaangacaagtttcgtacaaaaaatttttatttg

SEQ ID NO: 52135 - DNA, 101 bp, rice(Oryza sativa)
  misc_feature (71): n=a or g
atatatctagttttttttaatagttctaaagttgaggtaagaaaatcagactccgttagagtcgacagacntaaggtggtgtttaggatgggatggactta

SEQ ID NO: 52136 - DNA, 101 bp, rice(Oryza sativa)
  misc_feature (71): n=t or c
attcattcgtcccgacaggttcactcgctgtactaatcgaggagttgacgaactgtctcttgttcatctcncctccctgcttagatttggaccgagatgca

SEQ ID NO: 52137 - DNA, 101 bp, rice(Oryza sativa)
  misc_feature (71): n=t or c
acgtgcatattcagttgaacctgattctttccctgattgttgaccaacattgcgcattatattgactgcanagtatgtacaaatcatccatatattattga

SEQ ID NO: 52138 - DNA, 101 bp, rice(Oryza sativa)
  misc_feature (71): n=t or g
gaggtgatatgtaatagatgcagtatagaggatgcatgtggccacgacacatatttaattgcagttcatanaattatttcaattaaaatcatcgttctacc

SEQ ID NO: 52139 - DNA, 101 bp, rice(Oryza sativa)
  misc_feature (71): n=t or g
agtataaaatactatgactaatcacagcacagacaacgtgctactaccccactaatgatagtctaataganttcgtcagcagatgcagcgaccggactagt

SEQ ID NO: 52140 - DNA, 101 bp, rice(Oryza sativa)
  misc_feature (71): n=a or g
atgccctatggttgaaaacagtatggaaatttccggctatcatttctggtctgcacctaccgttttagtcngtatcggcaattatcagtgttggaaataga

SEQ ID NO: 52141 - DNA, 101 bp, rice(Oryza sativa)
  misc_feature (71): n=a or g
atacgatagtcctgcgtgcagctgcgtcctgcgttgtggacagtcgttagtagggggattggccaatgtanttgcccggcggcgagtagttgcaggtgatg

SEQ ID NO: 52142 - DNA, 101 bp, rice(Oryza sativa)
  misc_feature (71): n=a or c
ctatacccgtgtctgtgtgatgaacgttaaccccgtatgtaatcaacgattctggctgtgttctttgctcngtgttatcaactcatcttcctcatgttaca

SEQ ID NO: 52143 - DNA, 101 bp, rice(Oryza sativa)
  misc_feature (71): n=t or c
tgaggagtgttttttacattgaaaacgaaaaggtaaatcctgaatgggtcacatctagtgctatcgttgancaaaagttgtcaatttttatgggtttccaa

SEQ ID NO: 52144 - DNA, 101 bp, rice(Oryza sativa)
  misc_feature (71): n=t or c
ggaaacataatcttcacttattggataacttacaaattcaaaccattttgcatttccacgtatcctaaacngtatgtatggttgattcccaccagccaaca

SEQ ID NO: 52145 - DNA, 101 bp, rice(Oryza sativa)
  misc_feature (71): n=a or g
aaatagtcacaaccgtcattgggaggtcgttatctaccgaacgcaatctgggcctgggttagcggcctctntcacagttcggccgaaccctggccggcttc

SEQ ID NO: 52146 - DNA, 101 bp, rice(Oryza sativa)
  misc_feature (71): n=a or g
attgcttgaactaactcggttgttctaaacaatcggtaaagaatctccatgtgtacgaactgtatgcctcnagaacattgcaaacattaaccattaaaacc

SEQ ID NO: 52147 - DNA, 101 bp, rice(Oryza sativa)
  misc_feature (71): n=a or g
caaacatgcaggtatattccagccatttctttgagcactgcatgttgataataccatgttctatctgcatntctataggatgttagcaataatggcatcta

SEQ ID NO: 52148 - DNA, 101 bp, rice(Oryza sativa)
  misc_feature (71): n=a or g
agtcaaattggttgctagtttgatctcatcaggtaaactcaacttcgaaggtttcccctctcttgctgagntacaacgaacagcagatggcacgaatttga

SEQ ID NO: 52149 - DNA, 101 bp, rice(Oryza sativa)
  misc_feature (71): n=t or c
agacttcagagtacgacggattgtagtgtccaatgccgtaccaaatatcggacgtatgtacgtactctctncatcctaaaataagtcaacctcgtactagt

SEQ ID NO: 52150 - DNA, 101 bp, rice(Oryza sativa)
  misc_feature (71): n=a or g
tggtgactccctcagttgatgcatgcgctctatgagcagttcaaaatgcatcgtttacataaagatcagcnagggaggcaagcttcttcgcaaactctggg

SEQ ID NO: 52151 - DNA, 101 bp, rice(Oryza sativa)
  misc_feature (71): n=a or g
gcacgactctgtctctctcctctcgccctagcccctagcgtagcgatgcgatctcatctcatcttatcacncaatagcgttgcgccgccgccgtcccgcgc

SEQ ID NO: 52152 - DNA, 101 bp, rice(Oryza sativa)
  misc_feature (71): n=a or g
aaaatccaaaaagaaaaaagaaacagcaccaaaaaaatcccaaaaaaattaatccctccgtgtgcgcgccncctacgcgcgcgcgagttagctttctcgtg

SEQ ID NO: 52153 - DNA, 101 bp, rice(Oryza sativa)
  misc_feature (71): n=t or c
accatcgagaccaaatatggagtaatgtaaccgtccagtcacatgtcatcgacagtgaaagatattcatgnaaggttttccacgcaattatgatttatggc

SEQ ID NO: 52154 - DNA, 101 bp, rice(Oryza sativa)
  misc_feature (71): n=a or g
agttcccacctgttccgcggtactcgggcaaaacggacccgaaggaatttctgtccatctatgagtccgcnatcgaagccgctcacggcgacgaaaacacc

SEQ ID NO: 52155 - DNA, 101 bp, rice(Oryza sativa)
  misc_feature (71): n=t or c
ggggagggctctagggagaggcgaggcaaagagactagcggggagatgggtggtggggtggagaggttggnagggagatgggtggcacttgttgaccagtc

SEQ ID NO: 52156 - DNA, 101 bp, rice(Oryza sativa)
  misc_feature (71): n=a or g
gcatgtggagtatgacaaaaataattgtcacaaaaatgaagttggcccatttataacatgggctggttttncaattataattcaaataagcctaactagcc

SEQ ID NO: 52157 - DNA, 101 bp, rice(Oryza sativa)
  misc_feature (71): n=a or c
aatagagaggaatagaggagcaaaaaccttgcaaggaatccaatacaatttcttgcacaacatttagcatnatcatgttatgtaatccatcttctctacaa

SEQ ID NO: 52158 - DNA, 101 bp, rice(Oryza sativa)
  misc_feature (71): n=a or g
atctgtcttggcttgaaagatctctgagagtgaagtatttgcggctaaactctaaaccctaagactatccnttgaatcaaatagttcaaaattatcagaac

SEQ ID NO: 52159 - DNA, 101 bp, rice(Oryza sativa)
  misc_feature (71): n=t or g
gatgttgagtcatcacggaccacttttctgtgacgagggatctacccgtcacagatgatatgttccagcanagtgtatgtgccacttaataagttttattt

SEQ ID NO: 52160 - DNA, 101 bp, rice(Oryza sativa)
  misc_feature (71): n=a or g
cgaagccatccgcatcaccaagcaaatcaatggctagagaagccgcctcactccaccatcctccactgtcnccactccaatccccgccgccaccttcgtat

SEQ ID NO: 52161 - DNA, 101 bp, rice(Oryza sativa)
  misc_feature (71): n=a or g
tatatggctttagtggttcctttattcaagcaacatggggtgaagaattggctaggtttcggcccattagntagttcatatggcttaattggtgatttatt

SEQ ID NO: 52162 - DNA, 101 bp, rice(Oryza sativa)
  misc_feature (71): n=a or g
agcctccaatgagaaagccactgcaattatgctttggctttcattgcgagagatacagatggatgattttntggataagtgcttctttgttgagatgttaa

SEQ ID NO: 52163 - DNA, 101 bp, rice(Oryza sativa)
  misc_feature (71): n=t or c
tttgccttgggccatttttggcccaagtcctccctcctttgggctcgacccaattccgccctccttcctcntttctcctccccgcggtagccctcctcccc

SEQ ID NO: 52164 - DNA, 101 bp, rice(Oryza sativa)
  misc_feature (71): n=t or c
caaagagcaaggagtgccagtaaagctgagtaattaagggtggtttgcttgtacacatgcaattaatgggntgactagtgaagtgcacatcttatttacgg

SEQ ID NO: 52165 - DNA, 101 bp, rice(Oryza sativa)
  misc_feature (71): n=a or g
ccatgagaaaattttcatgatgcacgagagggaaaggaaagggaggtgcaagtagaaggaaggaaggaagnaagaaagaaagaaagaaagaaagaggaggg

SEQ ID NO: 52166 - DNA, 101 bp, rice(Oryza sativa)
  misc_feature (71): n=a or g
gtgatttattgggagcagcactttgcgttttgtgtgatttgttgggacggatcaagcaagtactacctctntattttaaaatgtacgacattgttgacttt

SEQ ID NO: 52167 - DNA, 101 bp, rice(Oryza sativa)
  misc_feature (71): n=a or g
tagctgtatactagttacataatgtgatgctgattccagcttggctacaagaatgtgatgatagcaacgtngccgaccgagcggagacccaaaccggatgc

SEQ ID NO: 52168 - DNA, 101 bp, rice(Oryza sativa)
  misc_feature (71): n=a or g
agtgagagaagtaagttattggtaatgtaacatccccacttataaataattattacttcctccgtcaaaanaaattgtggacttacacaaattcttgtgtt

SEQ ID NO: 52169 - DNA, 101 bp, rice(Oryza sativa)
  misc_feature (71): n=a or g
atgaagggaaataatatgatcaacccatcttcctttccttccttcacccagggttaacaatctcaacgaanaccatttgattttttaaaactttaagcttc

SEQ ID NO: 52170 - DNA, 101 bp, rice(Oryza sativa)
  misc_feature (71): n=a or g
cacaggtaaacaactcatgggttaagaagaggtttatttaattattaggtacagtggggcccacttgtcanagacaattagagggttcaacatggtgattt

SEQ ID NO: 52171 - DNA, 101 bp, rice(Oryza sativa)
  misc_feature (71): n=a or c
tttttcgtcaacactctcctgcttagaaggatgaaattgagcaccaagtggctgagatgcttcagtctggnatggtggttcctagtctcaacccatttgct

SEQ ID NO: 52172 - DNA, 101 bp, rice(Oryza sativa)
  misc_feature (71): n=t or c
agcatgtaagttctctgaattatgtccacagagagatacactttaatatagccaagtagctaaccaatttnccaatgcactatacgcaggttagcagctgt

SEQ ID NO: 52173 - DNA, 101 bp, rice(Oryza sativa)
  misc_feature (71): n=t or g
ttgtatactgtggaatcgataaaaacgaataggggaagtactatctgttctaataaggattatattttttncacggtctttaataactagtattttattat

SEQ ID NO: 52174 - DNA, 101 bp, rice(Oryza sativa)
  misc_feature (71): n=t or g
tcacatcatgttggcaaatggtatgatgatgttatcaagcttagaaggtagagagacctgctgctgctgcngctgctgctggtcttgctgtgatccgccga

SEQ ID NO: 52175 - DNA, 101 bp, rice(Oryza sativa)
  misc_feature (71): n=t or c
aaacaggggtgcgcagcgattgatacttactctgcgtggtttccaacccttccatgtcgttttccgcacgnacgcttttcgaactgctaaacggtacgttt

SEQ ID NO: 52176 - DNA, 101 bp, rice(Oryza sativa)
  misc_feature (71): n=a or g
tcaaccattggacacgcagctgcacatcttcacactcacatatgagcgttggtgtgcacgtttatcccttntcttcttaattctttgagttggatcaattt

SEQ ID NO: 52177 - DNA, 101 bp, rice(Oryza sativa)
  misc_feature (71): n=t or c
atgggtgaagaaattaaatggagaatgactatgattggttaagagaaaatagtaggtaaagaaatagcttnattttaagataaaacattacgctagaaata

SEQ ID NO: 52178 - DNA, 101 bp, rice(Oryza sativa)
  misc_feature (71): n=t or c
tgtgcctgtttggttgtgtgcaactatcttagagccagacccgatggatgcaaaaaaagacccatggagcnaggctgagaggaaatggtcgaatcaacctt

SEQ ID NO: 52179 - DNA, 101 bp, rice(Oryza sativa)
  misc_feature (71): n=a or g
aaacattttttttcatatataatacacagaaatcgatgcagtctcttcctctcttgcatcatattaagttnagaagttgctaaattgttaaaatcgatgga

SEQ ID NO: 52180 - DNA, 101 bp, rice(Oryza sativa)
  misc_feature (71): n=a or g
ctcgtatcgtaaacgtaagttccctcatgcacggcctcaaccatcctgtttgccacttagcttaaatgccnataaaattgtattgcagagaatccatctca

SEQ ID NO: 52181 - DNA, 101 bp, rice(Oryza sativa)
  misc_feature (71): n=a or g
cttactttgttgtaaaaggaaccgtcacatgccaaatgatcaaaggaatattgcaatttcgataaatatanattgtgaaacaatacagatcgacaagagta

SEQ ID NO: 52182 - DNA, 101 bp, rice(Oryza sativa)
  misc_feature (71): n=t or c
acagattagttattataaatatgtttggaaaaacatgtacattctttaagtatcatcgaatgattaacctngctcattttcaaaacagagtattatattta

SEQ ID NO: 52183 - DNA, 101 bp, rice(Oryza sativa)
  misc_feature (71): n=t or g
tggcacgcttgggtggcgagcaagaacgagacgatgatgaagacgattttggttcccctgcagcagtttgngatctctggagaccacactgtggtgagcag

SEQ ID NO: 52184 - DNA, 101 bp, rice(Oryza sativa)
  misc_feature (71): n=t or c
gttctagcaccaaaattcatagtcctaggatctacatggtatcatatctagacaaatggttgtccagattnattttactgggcataggttgtcttttttct

SEQ ID NO: 52185 - DNA, 101 bp, rice(Oryza sativa)
  misc_feature (71): n=a or g
tgacagcaggttcttaccttgcatatacagagtaccagagccactgagtgctatggcccatggaaacccantcgcctgggagctctgcagcagcttgctct

SEQ ID NO: 52186 - DNA, 101 bp, rice(Oryza sativa)
  misc_feature (71): n=a or g
gtaaaaatggatctatttttacaggtggtcctcgtaagacgaacacctacaagaaattattttcactagcnggtcttgacagggatcccctatgtattttt

SEQ ID NO: 52187 - DNA, 101 bp, rice(Oryza sativa)
  misc_feature (71): n=t or c
acttagaaaatgaattacaataaaaaaaacccttaatctcttaagtttcagtatttgaattttaagacggnccataagctaaaatgcagatgagagccgat

SEQ ID NO: 52188 - DNA, 101 bp, rice(Oryza sativa)
  misc_feature (71): n=t or c
agattcttcgggagagttttgtgcaagattccaagaaggtggattatcgtcgagttgctcaactctaagtngatcactttttctattctctttaactcatc

SEQ ID NO: 52189 - DNA, 101 bp, rice(Oryza sativa)
  misc_feature (71): n=a or g
cgatctctccagttgtattgcatatgtatgaaaaacaattctttcctgaataagacacagggaccgaaggnctgtttggttgttatcttcaatttaccatg

SEQ ID NO: 52190 - DNA, 101 bp, rice(Oryza sativa)
  misc_feature (71): n=t or c
gctgatagcctattggggaaaatatctcaacgaccaatggacctgtcgtgttggacctgtatgtggactcnagtggctaccacaagtagtggccttcctac

SEQ ID NO: 52191 - DNA, 101 bp, rice(Oryza sativa)
  misc_feature (71): n=a or g
ccgtgcaaataaggtcctagacagtattgtatccggttttggctgatgtggccgcatacgtggctcctttnactaggtcattgtcccacatggcattgacg

SEQ ID NO: 52192 - DNA, 101 bp, rice(Oryza sativa)
  misc_feature (71): n=a or c
ttaaactggagaaaattacaaacaaaagctgagaccacgcatcaccaaacacgcatttacaaacttaatcncatgactatagtcgtagatatcaaataaaa

SEQ ID NO: 52193 - DNA, 101 bp, rice(Oryza sativa)
  misc_feature (71): n=a or g
ggcagggaaggaagtagatggatagagtttggggataggagggaaggggatagatttggttgtttttcggnaaaaaaaaaaccttgtgtttttcatgttta

SEQ ID NO: 52194 - DNA, 101 bp, rice(Oryza sativa)
  misc_feature (71): n=t or c
gagattgacaaaaatactttttttagtcttctgattggcagatgcttgattggagttgtgctgctcctcgngacaaacatgaaatggtaagaaatattata

SEQ ID NO: 52195 - DNA, 101 bp, rice(Oryza sativa)
  misc_feature (71): n=t or c
tttgtacaattattttattttcatttatgataaggtttctacttcaatgacagcaatcacatgggatgatngttggggcaagcaaactttatagatgttat

SEQ ID NO: 52196 - DNA, 101 bp, rice(Oryza sativa)
  misc_feature (71): n=a or g
cactcacaccaaaaagactacaacttttctagccacgtcttttcattttatccaaaatagaaactcagctnagattaattttgagttttagcaagcacaat

SEQ ID NO: 52197 - DNA, 101 bp, rice(Oryza sativa)
  misc_feature (71): n=a or g
tttaaaaagtggttaaaagagagagaagagaaaggaaaatagaatagataagccacctgcagcattacccncgtaataatcgtgtgaaagctctactttgc

SEQ ID NO: 52198 - DNA, 101 bp, rice(Oryza sativa)
  misc_feature (71): n=t or c
ctttttctttttctgtttttattccataatatccgttttttcttttccgtatcttttttctgtataaatangtatgtatgcaaactttgtatacgcgtata

SEQ ID NO: 52199 - DNA, 101 bp, rice(Oryza sativa)
  misc_feature (71): n=t or c
tattgagattataaaacatgcattttgcgaaaataagcagcgttgtttattggccgttctggatggatganaagtggattctaaaaaaaaaacaattgcta

SEQ ID NO: 52200 - DNA, 101 bp, rice(Oryza sativa)
  misc_feature (71): n=a or g
atgcttcttgagtcttctttgtgcacagcagtatgatttgggacaactcagaagtgctaactattgagacncatcattttaaacttaattgatatatatat

SEQ ID NO: 52201 - DNA, 101 bp, rice(Oryza sativa)
  misc_feature (71): n=a or g
gaaccctactttttttttctagtagaagagacagaaaactcttatccatcatcatgttttaagattccacnatgttttgtacctgcaacccacgacctgcc

SEQ ID NO: 52202 - DNA, 101 bp, rice(Oryza sativa)
  misc_feature (71): n=t or c
gcgttacaatcatccactctcaagatatttaatcctattatatatatcattgtatttactacatccgttcnaaaatacttgtcgctttgagtttttgtttg

SEQ ID NO: 52203 - DNA, 101 bp, rice(Oryza sativa)
  misc_feature (71): n=t or c
tgctgctgttcactgtaaccaaacttttcttcagccttaataaatcttggccggcttctcatcgtcggccnggcaataaaataataatctataacttaacc

SEQ ID NO: 52204 - DNA, 101 bp, rice(Oryza sativa)
  misc_feature (71): n=t or c
ttaccaaattatgtgggtagcacacttaacataagaacataacaaaaatgtaccggcgccaatgttgcganacgtggcttaatgggagcacgatggccatg

SEQ ID NO: 52205 - DNA, 101 bp, rice(Oryza sativa)
  misc_feature (71): n=a or g
agtctattgtacgtccctactctttgggccatgccatataatatatctatttctccactatattctttgtnccgtgccttacatatggttgaaaataagtt

SEQ ID NO: 52206 - DNA, 101 bp, rice(Oryza sativa)
  misc_feature (71): n=a or c
ttgatggattttcccacttcatctcttagcttccaattctggcatgtcttacaaaaagaaaaaagaaagcnagaaatcaacaagatatgcacaacacttca

SEQ ID NO: 52207 - DNA, 101 bp, rice(Oryza sativa)
  misc_feature (71): n=a or g
acaaaagggagggacgacagcggctgcagcacacgaaggaacggcggtgttgatgcacggagtgaggaggnaggaaggggcggtgctggcgcgcggaggga

SEQ ID NO: 52208 - DNA, 101 bp, rice(Oryza sativa)
  misc_feature (71): n=a or g
aaaagtgaagaggagaagaaaagtgaagagagagaaaaaaagatgcgtgaagctgacaagtgggccccatngaatttttttattttttttctgactaggat

SEQ ID NO: 52209 - DNA, 101 bp, rice(Oryza sativa)
  misc_feature (71): n=t or c
atccctcaacttatataaccatacaaacgaagtccctcggtagtattgactccagttttaactgacatgangcctttgactaagtcttcgtcccacgtgac

SEQ ID NO: 52210 - DNA, 101 bp, rice(Oryza sativa)
  misc_feature (71): n=t or c
tgtcgcctgacaccggtccttatattgtagatccgcccctttaaacaatcaaatctgaaatttgctcatangaagactcaggaccttgggtgctactcatg

SEQ ID NO: 52211 - DNA, 101 bp, rice(Oryza sativa)
  misc_feature (71): n=a or g
acccttttacagcactggatgtggctgaagcatttatgcaacatattcatcgtctccacggcttacctcantccatcatctctgatcgggatcgaattttc

SEQ ID NO: 52212 - DNA, 101 bp, rice(Oryza sativa)
  misc_feature (71): n=a or g
tcccgacgaacaagctggcccaccagggaggccatcgctatgcaaagtggccatctctatgcagaacgacncgaggcacaccggtgacggtgaggagctaa

SEQ ID NO: 52213 - DNA, 101 bp, rice(Oryza sativa)
  misc_feature (71): n=t or c
ggcagactcctaaaccggaattgattatcaccgacacggcattgcaaagacagtatgtgtccatttattcncaaaccccttgagcccaaaaattgaagtga

SEQ ID NO: 52214 - DNA, 101 bp, rice(Oryza sativa)
  misc_feature (71): n=a or g
attgctaagaacacatatataaaaattttgtttacgaattacatttagttgtttgttgaatagtcgttacngcttattatgagtataagcgaaacaatcat

SEQ ID NO: 52215 - DNA, 101 bp, rice(Oryza sativa)
  misc_feature (71): n=t or c
ccacacgctgtgtttggccaaacaacgcatgcgtgaccggccgcccatctctccctcactacaggcccgcnctctagccaccagcttcgcagcactcgctc

SEQ ID NO: 52216 - DNA, 101 bp, rice(Oryza sativa)
  misc_feature (71): n=a or g
ataaagtgtcatgagcttctttcaggattgtatctttcaattccctgttgtctgggacacacattctctcncccaaccatacagttccttgctcatcttcc

SEQ ID NO: 52217 - DNA, 101 bp, rice(Oryza sativa)
  misc_feature (71): n=t or c
cgtcgccgactggtggcttctcctacatggcggtaaactccgccacgctactgatgggtgaccttgcctcngccgcatgttggtagttgttataatcatag

SEQ ID NO: 52218 - DNA, 101 bp, rice(Oryza sativa)
  misc_feature (71): n=t or c
gaatattctgcaagcattatgcagtttcctaaaacgaatcatccgataaaccaaagcagatgaaacagtancgcatttatagagaaaaaatgttttcccta

SEQ ID NO: 52219 - DNA, 101 bp, rice(Oryza sativa)
  misc_feature (71): n=t or g
gctgctcgagaacagttacggcgacgatgacgacgaggccagcaaagtttgctgcttctacaagctccatnaccagcttcccgccgtgctcgtcatcgacc

SEQ ID NO: 52220 - DNA, 101 bp, rice(Oryza sativa)
  misc_feature (71): n=a or c
aagaagggaaggaagctacataggtcctatcctcctaggaagcccactagaaactacagaagtattgatanaatgtcacatatatactcacatagttacta

SEQ ID NO: 52221 - DNA, 101 bp, rice(Oryza sativa)
  misc_feature (71): n=a or g
ggcccgaagaacggaagaaggaaagaaagaagagagaaaaagaggaggagaagaaaaaatatgtgtagctnacaagtgggccccatgtacttttttaattt

SEQ ID NO: 52222 - DNA, 101 bp, rice(Oryza sativa)
  misc_feature (71): n=a or g
agggagtggtgggtggcctcctcacggtgtgggcttggcgggaggcctccatggagagggagtgatagatngcttccaacggtgagggcgtggcaggagga

SEQ ID NO: 52223 - DNA, 101 bp, rice(Oryza sativa)
  misc_feature (71): n=a or g
cagcacggaacgaaggcatgaccacgccatcaacagtgcgtaggtcttcgaatgaggtggagcccgccacntggtttagcagcacccgaagatagtaacgc

SEQ ID NO: 52224 - DNA, 101 bp, rice(Oryza sativa)
  misc_feature (71): n=t or c
atatcgaatcatacaatttgtaaattttgttgtatctatttatacagctatggcgtaccatgatcatgtgncatagatgtaatttactcttgaaatgcaaa

SEQ ID NO: 52225 - DNA, 101 bp, rice(Oryza sativa)
  misc_feature (71): n=t or c
aagggtttgttcaccagtgcaagctaccatctcctctcgacttattatatatgaacgcaagtttggaaaanatttgtttcgaaatgtactttcataatttc

SEQ ID NO: 52226 - DNA, 101 bp, rice(Oryza sativa)
  misc_feature (71): n=a or g
tcgactcgcgctctagcctttccttcacatgctatctcgtgttggtctactccgttcgtattcactggtanagaaaccatctttggtcggtcgacccaaat

SEQ ID NO: 52227 - DNA, 101 bp, rice(Oryza sativa)
  misc_feature (71): n=t or c
acaatgccacccctctctctctcttttctcctcgtcatcggccggttgccgccccaatcgcccatgattcngccgccccgagcccttaaaaaggatgcccg

SEQ ID NO: 52228 - DNA, 101 bp, rice(Oryza sativa)
  misc_feature (71): n=t or c
tcctttgacacggataaattagtagatgtttataatctgtttttgtctggtgtgaatatcaatggcatgcnctatcaaattgttcatagtttaaatagatt

SEQ ID NO: 52229 - DNA, 101 bp, rice(Oryza sativa)
  misc_feature (71): n=a or g
gaaaagtcgtgtgaataaatgcggtaaacacgcggtcgacgactgaccccccggagtcgttgcgttcaacnacgtgcgtactcaaggggtgtttggaagag

SEQ ID NO: 52230 - DNA, 101 bp, rice(Oryza sativa)
  misc_feature (71): n=a or g
gtgtttcagaacagataatgtttggtggtcggtgttgtagatagatcgaggcaacttgggaggaggaggtnttggactaccaacgtcgatgcgggctacga

SEQ ID NO: 52231 - DNA, 101 bp, rice(Oryza sativa)
  misc_feature (71): n=a or g
agccaaatgtgcgtgggccctcccggcttggaaggataggatgtgttcggcttgccgaggtccaaataccntgtatgtatgctcgtccgattaagagtcga

SEQ ID NO: 52232 - DNA, 101 bp, rice(Oryza sativa)
  misc_feature (71): n=t or c
gctaaatttgggtgcaaacaacggctctaacagatgaacataccgtatgtaatccaagcttgagaacatgntaacttactgagtgcctgaatctaacagga

SEQ ID NO: 52233 - DNA, 101 bp, rice(Oryza sativa)
  misc_feature (71): n=t or g
acaagcaagaaaactcagtcatcacagcaaacaagcaagaaaagggaaaaaatgaacatctcaatgggctnatctattatatcaaaagtagtgatgcttta

SEQ ID NO: 52234 - DNA, 101 bp, rice(Oryza sativa)
  misc_feature (71): n=a or g
aatcaatcacaagggcacacagaaagaggagagaatgagcgcgagcgcgagcgcgaagcgcgtacatcttngagagcttgttgggggcgccgccggtgacc

SEQ ID NO: 52235 - DNA, 101 bp, rice(Oryza sativa)
  misc_feature (71): n=a or g
agcgctggggccgcgactgcgatccacgcagtctcgcgctacaggaacacgagagcggtaattagtgattnattaccataattagtgattatttaatgata

SEQ ID NO: 52236 - DNA, 101 bp, rice(Oryza sativa)
  misc_feature (71): n=t or g
gaaatattcctggagagaaaaggcagaaatgcgagaagttaataactctttgatattgcattaaaacctanaaagtgacagggtggctagtccttcacagc

SEQ ID NO: 52237 - DNA, 101 bp, rice(Oryza sativa)
  misc_feature (71): n=a or c
caagcactcatctgcagcaattcttggagatctgcaccacttacacggtaaaaggtgtcagtccggacgcngtaaggctacgtctattttctttctcactt

SEQ ID NO: 52238 - DNA, 101 bp, rice(Oryza sativa)
  misc_feature (71): n=a or g
ctttgaggaataaacaaaaaaagggccaaactaattgaaagggaaagacttacgcaggaagtaaggcttcnaaggaagaagttgatggcgtcatggttgag

SEQ ID NO: 52239 - DNA, 101 bp, rice(Oryza sativa)
  misc_feature (71): n=t or c
aacaccaaacagttcaaggccctatttgaagagtttctatcacctcccgcttctcccagagcttttcgtcnagattctaagaatctatagttgtagactaa

SEQ ID NO: 52240 - DNA, 101 bp, rice(Oryza sativa)
  misc_feature (71): n=t or c
agcaagtataatgcattttcaaatgcgggttggtagtcgtttctactagcactactggagactggagtacnggagaactgatctttgttggttcagcataa

SEQ ID NO: 52241 - DNA, 101 bp, rice(Oryza sativa)
  misc_feature (71): n=t or g
ttggtgtgtttgcttaaaaaattgacaagctttacatcgttgcactatttcacatacgtcttggagggcanttagtcagaacaaaccttgtctgaaagctt

SEQ ID NO: 52242 - DNA, 101 bp, rice(Oryza sativa)
  misc_feature (71): n=t or c
gcgggaagaagcaagggcatggatccggtgctgctcgtcactccgcccttgttcgtcttatactctctagngttgcccgttgctccggcgcaaagagggac

SEQ ID NO: 52243 - DNA, 101 bp, rice(Oryza sativa)
  misc_feature (71): n=t or g
atatgaaagaaaaacaaatagcttctaagacttagttgcggatgttcaacttctccatttaaaattcagantagaattgtatagatccaacatgggcatag

SEQ ID NO: 52244 - DNA, 101 bp, rice(Oryza sativa)
  misc_feature (71): n=a or c
gtgccagtttaattactggcagcatttgaatgattggtgccctgcctgcagtagtactagtagagcaagtntaatagtacagtctactcctagctctaatt

SEQ ID NO: 52245 - DNA, 101 bp, rice(Oryza sativa)
  misc_feature (71): n=t or c
caagaaagaaaaataaaagaacgacatttgaatagttcacatgaaaaactaaggatcagacaaaacagacngagtcaaaacccagaggttagagctcttcc

SEQ ID NO: 52246 - DNA, 101 bp, rice(Oryza sativa)
  misc_feature (71): n=t or c
aaatgcaagtgcagttctatatggaaatcatcattttaatgacttggagtatttggattaccagaaacaanaaggttttcaaagatatcaaccccacaatt

SEQ ID NO: 52247 - DNA, 101 bp, rice(Oryza sativa)
  misc_feature (71): n=a or g
cctagaactgtataggcatgcactagtttgcaatccaataacttaattagaattttgttttcgatatattngacgaaaaataactaagaattaatttcatg

SEQ ID NO: 52248 - DNA, 101 bp, rice(Oryza sativa)
  misc_feature (71): n=a or g
acatccacagattacctgtggatgatgcaccctagtaggagacgtcatgcgtaactgtgacgagcacgagngaaaggtgctcctcattctacgtgatggtt

SEQ ID NO: 52249 - DNA, 101 bp, rice(Oryza sativa)
  misc_feature (71): n=a or g
attattattgcctgttgattggatctttaattaatcgccggagaaaaaaaaagatcgatctgtgatgtganatgctctggtccatgtatgaggaggcgaag

SEQ ID NO: 52250 - DNA, 101 bp, rice(Oryza sativa)
  misc_feature (71): n=a or g
tataaccttggcatgctataaaaatatgtagtgtaaactgtgtatatagtgaaaacctagaaacaatcatngaataaaaaaatgaacgtgtaagatttttc

SEQ ID NO: 52251 - DNA, 101 bp, rice(Oryza sativa)
  misc_feature (71): n=a or g
ggacggtggtttgatccttgatctgaaaaaaaaaaggggaaaaaaatgaagtgaacagtataatgtatatncaccgagtaagatgggtttgtaaaaaaaaa

SEQ ID NO: 52252 - DNA, 101 bp, rice(Oryza sativa)
  misc_feature (71): n=a or g
gataaactaaaggtccctaaatagttggagattgaagccgcccccccccccaaccaattttttgttcctgnatccgcccctgcatagaatgatcaacaaac

SEQ ID NO: 52253 - DNA, 101 bp, rice(Oryza sativa)
  misc_feature (71): n=a or c
gaatataatggactagtgataatgttgtcatatccaacatcaatacactctaggcaggcagaaaccatatnattgaaattaagttcagtttagctatggtg

SEQ ID NO: 52254 - DNA, 101 bp, rice(Oryza sativa)
  misc_feature (71): n=a or g
aacagggtggttgtgacagagacagactcaccatcgccactagaaccgccactagagtcttttagaagaantatgtatgtcatatgatttgtctaaaatta

SEQ ID NO: 52255 - DNA, 101 bp, rice(Oryza sativa)
  misc_feature (71): n=a or c
catcattaattcgagaaagaaattatatcctttcaattaattaaaaagtcatgcacgataatataagtatnttgaaataaatgattttggttcaaaatatc

SEQ ID NO: 52256 - DNA, 101 bp, rice(Oryza sativa)
  misc_feature (71): n=t or c
gctcccggttagcatacttcctattttctagtttctgctcattttcaaggtttggaggagcagaacatatngatgatgagattcaattacatgagcagaac

SEQ ID NO: 52257 - DNA, 101 bp, rice(Oryza sativa)
  misc_feature (71): n=t or c
gtcatttgcgaggctactctctaggggcacgcgttgctgatggcctaagttcccacacaaaaattttatancctgtcacatcgaacgtttgaacacctaca

SEQ ID NO: 52258 - DNA, 101 bp, rice(Oryza sativa)
  misc_feature (71): n=a or g
gcaaagccgtcgcgtgggcatcgtgggagcatggatgcgcaggacatccatctcggtctgaggcagcagcnccaccaccaccctcttcctcggtcccctcc

SEQ ID NO: 52259 - DNA, 101 bp, rice(Oryza sativa)
  misc_feature (71): n=a or g
cgaaagaagagaacatctctagcgcccctgcctgtccagaagtagttgttgccgtacgcgacacgagcatnccggcgtgctgcagcgcctcgacgccggca

SEQ ID NO: 52260 - DNA, 101 bp, rice(Oryza sativa)
  misc_feature (71): n=a or g
atatacgagcctggtaccgcatagatcaagcctctaactcaatatgcacacatgcatgctgagccaagccncttccaatgccaacgccatccatgtagacc

SEQ ID NO: 52261 - DNA, 101 bp, rice(Oryza sativa)
  misc_feature (71): n=t or c
aacgagtcgacgagagctccgttcaattgctagatgattcctccgtcctaaaatattactccctccgtttnatattataatactttctagcattgctcaca

SEQ ID NO: 52262 - DNA, 101 bp, rice(Oryza sativa)
  misc_feature (71): n=t or c
acatcaagccaatgtctgcagaaagcttgcaaatttttctaaagcgggccccaccttacttccccatcccntacataaacattgtggatgttgtgaataac

SEQ ID NO: 52263 - DNA, 101 bp, rice(Oryza sativa)
  misc_feature (71): n=a or c
aatcttccatgagattttaggttgattttgtggcatcgattgaaattctaaattctcttgtttttctaatntcttattttataaagatacgacccactaac

SEQ ID NO: 52264 - DNA, 101 bp, rice(Oryza sativa)
  misc_feature (71): n=t or g
tcctcctcttctccttgttcacttccattttcttggtcttggggctgtggctgcttgtggttaagaacagnatgctttctatgtgtgttaatatctatcct

SEQ ID NO: 52265 - DNA, 101 bp, rice(Oryza sativa)
  misc_feature (71): n=a or g
gttggaccatccctggaagaaaaattaagcttcgaatgcatacagggatgtcattgccatgcatatgttcngaccaaccatttttaaatggcaaattttgt

SEQ ID NO: 52266 - DNA, 101 bp, rice(Oryza sativa)
  misc_feature (71): n=t or c
gtggcaggtttggttcacttatgtgcttccctcagtgactctacagaccagttatcctcagttccagatgntgtctagtctttggtacatgaattctctca

SEQ ID NO: 52267 - DNA, 101 bp, rice(Oryza sativa)
  misc_feature (71): n=t or c
ctgaaaaatcacatctatagtagtgttttgtaatcccactcatgaaaaatttaagggttctcatcactccngtcatcctgtatttaaacaaagacattctt

SEQ ID NO: 52268 - DNA, 101 bp, rice(Oryza sativa)
  misc_feature (71): n=a or g
ctggatcccatccacacccgctctacatccgcttaaaaaaatgatgttggatatggtatgaccaatgtccntccgaatccgctccattttcacccctacgt

SEQ ID NO: 52269 - DNA, 101 bp, rice(Oryza sativa)
  misc_feature (71): n=t or c
caaagtcccgtatactttgatctactaattaagccggagataaatgcaccgaccgtatatgagttactctntctatctacttttgacagttatattttcaa

SEQ ID NO: 52270 - DNA, 101 bp, rice(Oryza sativa)
  misc_feature (71): n=t or c
ttcttcaaactttcaattttgacgtggaactaaatacagcctaaggatagcctaagggtcccaactacgantataggagattaatccatttttcaagttta

SEQ ID NO: 52271 - DNA, 101 bp, rice(Oryza sativa)
  misc_feature (71): n=a or g
tccgttcctaaatataaaggattttaattggatgtgacttatccttatcctactagaacgaatctgcacangctttatgtccagattcgttgtactagaat

SEQ ID NO: 52272 - DNA, 101 bp, rice(Oryza sativa)
  misc_feature (71): n=a or g
gcccgataaaccactcgaagacggcaaccaaatgtgttacatatcttagaagacatgaccaaaacgctgcnttccacgatcatctcaattactcaaaactc

SEQ ID NO: 52273 - DNA, 101 bp, rice(Oryza sativa)
  misc_feature (71): n=a or c
gggtcgcagtcgcgaaggtaaggtattaaatgccggtgagtgagtcaggagatctctctatacggcacatnatcttccgtgcaagccgaacaacaactagt

SEQ ID NO: 52274 - DNA, 101 bp, rice(Oryza sativa)
  misc_feature (71): n=a or g
tcttacattgcaataaccaaagttacggatcgcatcaatcaccatatttagcactgacaaaacaaagctanaaataatttagttttacataatcaatcagt

SEQ ID NO: 52275 - DNA, 101 bp, rice(Oryza sativa)
  misc_feature (71): n=a or g
atgtaggtgtacagacaattgccgtaggcacggaagggtacatagatccacagtgcaagaaagatggcacngtcaggttcaactgcccctcagatgtgtac

SEQ ID NO: 52276 - DNA, 101 bp, rice(Oryza sativa)
  misc_feature (71): n=a or g
ctccgcgagcccgacgcctaccgtggcctaccaccgcagagccggtgggaggatgagaagaagagataagngaggaggagaataagatataagggagagag

SEQ ID NO: 52277 - DNA, 101 bp, rice(Oryza sativa)
  misc_feature (71): n=a or c
tccccatactctttgtctaatgattgatcgattccatgagatttagaagcgtatcattggtctattggtcntatcatatcgtttgttgccagtttgatcag

SEQ ID NO: 52278 - DNA, 101 bp, rice(Oryza sativa)
  misc_feature (71): n=t or c
ggcagcagggatggatgatggattgagtgagtgatgtgtgcaagtgctaatccaatatggaaggaagaagntgtaaagatgaggaggaagaagaagatgag

SEQ ID NO: 52279 - DNA, 101 bp, rice(Oryza sativa)
  misc_feature (71): n=a or g
atttgccggtgggggaagaaaaagagaggagacagatgggaggggaagatgaaaaggtaaagaagaaaganagagagagaggggaagatgaaaagtaaaaa

SEQ ID NO: 52280 - DNA, 101 bp, rice(Oryza sativa)
  misc_feature (71): n=t or c
ctctcttaactcttttaccggtcgctttggtcagacatccaattagagggtgtttgcaattagagggttgnaaacaccctctaattggatgcctgaccaaa

SEQ ID NO: 52281 - DNA, 101 bp, rice(Oryza sativa)
  misc_feature (71): n=t or g
cattggtccaggaagcaggattggcgagagcccccgtttgaaatgaaattagtactccctccgtcccacantactaagcgattctaatttttttgttaatt

SEQ ID NO: 52282 - DNA, 101 bp, rice(Oryza sativa)
  misc_feature (71): n=t or c
cagttttcttgattggcatgagcttgttgattgataaaccctgtcaagtgttttcaggtaatggtaaatangagaagagtcccactatgatgcctcactgg

SEQ ID NO: 52283 - DNA, 101 bp, rice(Oryza sativa)
  misc_feature (71): n=t or g
atggttctgcagctgttgcagcagagactaattaagctcaacaacaataccacatgcaagaaatgcccaancttagtcctgccactagtaggaaagtaagt

SEQ ID NO: 52284 - DNA, 101 bp, rice(Oryza sativa)
  misc_feature (71): n=t or c
atttttatttcgggatgaatttatcaggacgtgacactattactaggttgtttcgtcacttcagggctttncactttgttgccatttttaatcgtactaaa

SEQ ID NO: 52285 - DNA, 101 bp, rice(Oryza sativa)
  misc_feature (71): n=a or g
aaattaactcctcaaaaaaatatatatttgatgatagacaagcgctagtaaatttctccatatttttgccnaatttctcatcaaaataaatagctccaaat

SEQ ID NO: 52286 - DNA, 101 bp, rice(Oryza sativa)
  misc_feature (71): n=a or g
agttaatttgtatatgagaaattttccatttccgattccaagaaaaaacttgaattcgtttccggtttccngcggatagtagccttatcatattcgtttcc

SEQ ID NO: 52287 - DNA, 101 bp, rice(Oryza sativa)
  misc_feature (71): n=a or c
cgaagtggaaggtaggacagtgtacgtcgaagtcgtcacttttttgggccagattttgggcccgttcaagnaaacatgggccttactatttgtacatgaat

SEQ ID NO: 52288 - DNA, 101 bp, rice(Oryza sativa)
  misc_feature (71): n=a or g
gaccggacgccatctggctgatcagtaccagcagcacataatggcggaagaatctctctatgtttggatcnaagcccatgacatagtatgtcatgcaaatc

SEQ ID NO: 52289 - DNA, 101 bp, rice(Oryza sativa)
  misc_feature (71): n=a or g
tccatctagttggaaataaattttgactactctgtgccctgggactagtatatacgttcagagttgttctngttttagaaaggggcaccttagtggagtac

SEQ ID NO: 52290 - DNA, 101 bp, rice(Oryza sativa)
  misc_feature (71): n=t or g
tatatcataatcagaccaccatgatacggcgaaagtatcacacctaaccatgcaggcggggcgagttgcancagcccgcaacccattagagcaagtataat

SEQ ID NO: 52291 - DNA, 101 bp, rice(Oryza sativa)
  misc_feature (71): n=t or g
ccacctccacgcaccactatcatcggattcataatctccaagtcgccaccgtcgttctctcctgcatgccnctgccgccataaacaacctcaccggtgacc

SEQ ID NO: 52292 - DNA, 101 bp, rice(Oryza sativa)
  misc_feature (71): n=a or g
tcattcacacatcacagatcgttcacacatcacaaatctcccgatatctcaacatctcaaatcatccatancaacaacctgatatcttaacatccaaatca

SEQ ID NO: 52293 - DNA, 101 bp, rice(Oryza sativa)
  misc_feature (71): n=t or c
tgtccgtaaaaaaaatctgactcccataaaataagagataaaatttcgtccgtagaaaaaaatctgactcncgtaaaataagagatagaaaacttctcacg

SEQ ID NO: 52294 - DNA, 101 bp, rice(Oryza sativa)
  misc_feature (71): n=a or g
tcagatgaaggttttgtggcgtgtgtgtttgtgttgtgttgcttgctggttggctacatgaacaactgtantatttcaggaaaaagatttatgcttcagta

SEQ ID NO: 52295 - DNA, 101 bp, rice(Oryza sativa)
  misc_feature (71): n=t or c
tatttcttaaatagccctgcaattgctagtggtgagagcgggagataatttctgtttactcctctgttggngccaaaataatccctccatcttcgttacca

SEQ ID NO: 52296 - DNA, 101 bp, rice(Oryza sativa)
  misc_feature (71): n=t or g
ttgccccgaatacgaccgactcgcacgaccggttttgcagtttgctccctctattgttttttttagagaanttttttttttttacccggcctctacatcca

SEQ ID NO: 52297 - DNA, 101 bp, rice(Oryza sativa)
  misc_feature (71): n=t or c
ccccgccttgctcgtgcgaaggtttttattccaccacatgtacatagcatgactcttgaagcgcatcaagnggaactacttgatatgatccagcgataaga

SEQ ID NO: 52298 - DNA, 101 bp, rice(Oryza sativa)
  misc_feature (71): n=a or g
atccatatgaagcacattaattcaacctgatgacgtataccgagccatattgttagaatcggctgtatcgnctaaccctgttcgactcgaactctgccaat

SEQ ID NO: 52299 - DNA, 101 bp, rice(Oryza sativa)
  misc_feature (71): n=a or g
tttgcttgtttgatcttggtggccgcaccaaatgaacacttgtgttttattttctagagttcaaattctcntatatatatatgtacttctcatttttcagc

SEQ ID NO: 52300 - DNA, 101 bp, rice(Oryza sativa)
  misc_feature (71): n=t or c
agttcacgttgttcgtcgcttcgggactggggctgggttgataaatcagggattggggcctacgctgtacntgtccaacccgcactagaccaggcccgatg

SEQ ID NO: 52301 - DNA, 101 bp, rice(Oryza sativa)
  misc_feature (71): n=t or c
ttaatattttagagtaacttctacataaaatagatttatttattattttacacgaaatacaccggttagangtttaaaaagcgtgctaacgaaaatcggaa

SEQ ID NO: 52302 - DNA, 101 bp, rice(Oryza sativa)
  misc_feature (71): n=a or g
cgtcgagacgaagctcacaatctccacatattttgatatggttattgttggattcatctactttgtatctnttctgtcacttcaagttgcccaatgttttt

SEQ ID NO: 52303 - DNA, 101 bp, rice(Oryza sativa)
  misc_feature (71): n=t or c
ccatacttttgcaccactgtccactgcttacgtaaaatcaacaccgtcgaagctgtctcgttaattcctcncgaagcgttgggggaggccgggagggtttg

SEQ ID NO: 52304 - DNA, 101 bp, rice(Oryza sativa)
  misc_feature (71): n=a or g
cattagtccttctgaagaaactagaagtctcaacagtgatagtataggtacatgcaagctacaaacatttnagtttaatcatgatatggtaaataagatga

SEQ ID NO: 52305 - DNA, 101 bp, rice(Oryza sativa)
  misc_feature (71): n=a or c
ccaagaccaacaacccatgacattttaatcggcatagcgattccacttaaccttgagctggtatagaaaanttggctaaaaacaaagggtccactacaact

SEQ ID NO: 52306 - DNA, 101 bp, rice(Oryza sativa)
  misc_feature (71): n=a or g
tgttgataattagtttcatgtcctttgcttctatagcagcaatgcagtttcagcttctcccaaggtgaaanctgtagtaaaaaaagagaacataatatgat

SEQ ID NO: 52307 - DNA, 101 bp, rice(Oryza sativa)
  misc_feature (71): n=a or c
ataccacatgcactgttcatacctaccccccatgggagggggggccacatagcctaagtcagataactgtncgtgccttcaaccagaagcaaagtggtcgt

SEQ ID NO: 52308 - DNA, 101 bp, rice(Oryza sativa)
  misc_feature (71): n=t or c
aagaatagaagtgaaattttcttgtgaaccgataagtttacaactactttccaattaattcggagcatttnggttttttttttcctcaaattttacttttt

SEQ ID NO: 52309 - DNA, 101 bp, rice(Oryza sativa)
  misc_feature (71): n=t or c
attaacagttttactattttaaactagaaaatgttttcaaccaccttgatgcaaatagtcgcaaacccctncttatctccccttgcacgaatgcatcattg

SEQ ID NO: 52310 - DNA, 101 bp, rice(Oryza sativa)
  misc_feature (71): n=t or c
caggcagccctccatcccccaactccatgccattggccgtgcggcccgtcttaattcttccccagcctggnctcctccaggaccacttcgtgctctacccc

SEQ ID NO: 52311 - DNA, 101 bp, rice(Oryza sativa)
  misc_feature (71): n=t or g
ttttgctgacgtggcgctgatgtggcggtgctaatccagtctttatcctcgtggcgcttacgtggcattanaattaaaaaaaatatctatgggacccatct

SEQ ID NO: 52312 - DNA, 101 bp, rice(Oryza sativa)
  misc_feature (71): n=a or g
tgtgcccaacatttaaaccccaagaaaatatcaagcgacagttgtacatgtggtgtggcaaatcttaaacntcccttctaaatatgattttctaacaatgt

SEQ ID NO: 52313 - DNA, 101 bp, rice(Oryza sativa)
  misc_feature (71): n=t or c
tagggaaataatacaagtacacaatagtaatagctaggtacagtctatctttaatttgtactccctccgtngcataataagcgtagttgtaggtttcagtg

SEQ ID NO: 52314 - DNA, 101 bp, rice(Oryza sativa)
  misc_feature (71): n=a or c
tatttcaggcccattaagaactaatgcccgcgttcatacctaatatttgggtatatttggttccagtaatnaaaaatcaagtgtgcatattctatgtataa

SEQ ID NO: 52315 - DNA, 101 bp, rice(Oryza sativa)
  misc_feature (71): n=a or g
agttacaatccataaaatgaattaagaagctagaagttggatttgtcaacttctccagattctcaccaacngcttctcagaattttaaactctcccaaata

SEQ ID NO: 52316 - DNA, 101 bp, rice(Oryza sativa)
  misc_feature (71): n=a or g
ccgtcgccccctttttgtacgccaccaagctcttgcagtgccgtaccctgccagtcggaggaggagaggtngtgccgtcgccaaaccggccgcggccgcct

SEQ ID NO: 52317 - DNA, 101 bp, rice(Oryza sativa)
  misc_feature (71): n=a or g
tgaaagtttgaagggaactaaacacaaccataaaaagcaatgtgagggaaacgaaaagtgaatcatgggtngtgtttggatctatgactaaattttagtct

SEQ ID NO: 52318 - DNA, 101 bp, rice(Oryza sativa)
  misc_feature (71): n=t or c
cgactagtagcgttttcaacatagtcctaatgatcctcgcaaaaaaaaaccatagtcctaatgataagatnaaattattgtttgataatataagctaccaa

SEQ ID NO: 52319 - DNA, 101 bp, rice(Oryza sativa)
  misc_feature (71): n=a or g
atcgggactagactcagggaggagttgaggtccggacggtataccaagtgacaaagttggatacgagatgncacacggtggatggatatcgtgtaggagag

SEQ ID NO: 52320 - DNA, 101 bp, rice(Oryza sativa)
  misc_feature (71): n=a or g
aatatgatgattatttaaaaataccatagaaaattacatgatgatcaattgggaatcagagggagcagaantatatatatggtccctcatggttttcattt

SEQ ID NO: 52321 - DNA, 101 bp, rice(Oryza sativa)
  misc_feature (71): n=t or c
cgctcgcgggcaggaggagcgttctgaaactggcgcaccggatgacgtcgagcctctgccgcaccaccggnggatcgtgtgacatggcgtggcgcagggcg

SEQ ID NO: 52322 - DNA, 101 bp, rice(Oryza sativa)
  misc_feature (71): n=t or c
tagattttttttgtttgtatagtagattgataatttttgggtttggagaattggaagggggtatactcacngcctctaatgaaagggtgattgtaaccact

SEQ ID NO: 52323 - DNA, 101 bp, rice(Oryza sativa)
  misc_feature (71): n=t or c
gagatggtgcacgtggtggcaacacaattcctcccttagacactttcttggttgttcatgtgcataaccgnctgcctttcgcctagtcgtggtgcccaatt

SEQ ID NO: 52324 - DNA, 101 bp, rice(Oryza sativa)
  misc_feature (71): n=t or c
gaaaactctcctccagattttaaagaattgtcttgtactccgaactaactcttttttgttttgattcccangggccagacgagaaaattgcaatattggga

SEQ ID NO: 52325 - DNA, 101 bp, rice(Oryza sativa)
  misc_feature (71): n=t or c
tggttgcatcagtccttgtgatcacttggctcaatctaaggtagggcacactaacaaggataaacaaaagntaacatgggaatcactattgatccattgtt

SEQ ID NO: 52326 - DNA, 101 bp, rice(Oryza sativa)
  misc_feature (71): n=a or g
acggaagtagcggcggcggcggtgcacagagggagtggcggcgacggcacaaagaggcaaacaacagcacnggaagggtcaaaaacttcggcgctggcgct

SEQ ID NO: 52327 - DNA, 101 bp, rice(Oryza sativa)
  misc_feature (71): n=a or g
tcaagtggtcaagaacaagaatatgactgaacacaaatttatagaacttgcaggttgcagcaaatagcaanaaggcggttcaaacctccctaaataattca

SEQ ID NO: 52328 - DNA, 101 bp, rice(Oryza sativa)
  misc_feature (71): n=a or g
cacacttgtttgattcatctaatcagtaacggatctaaaaattttcttgagcctaggcaaacctaacagcnggtgaagcatgcacataaaaccttgaccat

SEQ ID NO: 52329 - DNA, 101 bp, rice(Oryza sativa)
  misc_feature (71): n=a or g
ttaggagagttagctatgtcaaccggaaaggtacagctgttggatgtattagttactatcttctatgagtngtcaatatatattgtgctaatgaagtggga

SEQ ID NO: 52330 - DNA, 101 bp, rice(Oryza sativa)
  misc_feature (71): n=a or g
gagccccacgttataccctaccatcctgcacaaacaatgtggcgttagtatcctgctactaccgcctggcntgcggacccacgttactaccgaactcagtc

SEQ ID NO: 52331 - DNA, 101 bp, rice(Oryza sativa)
  misc_feature (71): n=a or c
cgcaagaagaggagagccttacatcatatggctacggcggttggtccaacaccaaatcaggttctcatgcntattccggcagtgacaagtccaccaagcct

SEQ ID NO: 52332 - DNA, 101 bp, rice(Oryza sativa)
  misc_feature (71): n=a or g
tcttttttttttgggacggagggagtatgtccctaaataagtaggtgtagccatggtatccgtgtccaacntttaaccgtccatcttatttgaaaatttta

SEQ ID NO: 52333 - DNA, 101 bp, rice(Oryza sativa)
  misc_feature (71): n=t or c
accatatcaatcataatgtttgtatgaatcgctgtagctaagacaatcataaggaaaattgaaacatcttngatgtaatggcccaacctcgacgatggcaa

SEQ ID NO: 52334 - DNA, 101 bp, rice(Oryza sativa)
  misc_feature (71): n=t or c
taataacacatgtggctttgtggccgaaaataaagggtggcttttgaaaaagaagatgtgggctataactntttgaaaagtagctttagaaaagtagttgt

SEQ ID NO: 52335 - DNA, 101 bp, rice(Oryza sativa)
  misc_feature (71): n=a or g
ggagagtccttttgatccagcaacaaacccaggcgctagccaatgggcagagcgactacgcgagactgacnaacctcaataccgcatttgttgaagtcgca

SEQ ID NO: 52336 - DNA, 101 bp, rice(Oryza sativa)
  misc_feature (71): n=a or g
ggctcttgctagctaaagatagctagctgtcaactggtgacttggcagaaaataagctgggaaaatgacangcgtgcatgcatgcacggccctgatggcca

SEQ ID NO: 52337 - DNA, 101 bp, rice(Oryza sativa)
  misc_feature (71): n=a or g
cgtgcggggaggagcgggagggaggtaaggagggacttggaagcttgctagggtcggtcatctggacgccnccgcgtcgatgccttcgatccagaggggtg

SEQ ID NO: 52338 - DNA, 101 bp, rice(Oryza sativa)
  misc_feature (71): n=t or c
gtgctgcttccggccttcgatcgcgacggttaaacgcctcgccgatctccctgacacagctttcgatttgngcaaacaataaatattccattttgctatat

SEQ ID NO: 52339 - DNA, 101 bp, rice(Oryza sativa)
  misc_feature (71): n=a or g
ctccccatgctcctcctgggctcctggccatgcagtcctactccatgatgcagagcaatggcgtgatcccncttgacaatgcgctgttcaagacgctccct

SEQ ID NO: 52340 - DNA, 101 bp, rice(Oryza sativa)
  misc_feature (71): n=t or c
tatagagcttgccatccccgtgcctcgccatgtcgacgattctgtccagcttgttgttgatgagacgccangagcgctcgcccgtgcgggctatggcgaac

SEQ ID NO: 52341 - DNA, 101 bp, rice(Oryza sativa)
  misc_feature (71): n=t or c
gtggccgggagggggctcgattttgccggagttagtggggatggtggagagagagagtggggattcaaacngaatcccaccctttttgggcgcgcgtgcgc

SEQ ID NO: 52342 - DNA, 101 bp, rice(Oryza sativa)
  misc_feature (71): n=a or c
ctttctccaccagtgactgggacatgcaaaggtgcttgttctttggtttccctaagtgcatagtgaagttntagggcttcgatcatgtctgctaccatatg

SEQ ID NO: 52343 - DNA, 101 bp, rice(Oryza sativa)
  misc_feature (71): n=t or g
gctgcatatatgactttacatctacatattcagatatttcactcttcagatacagagagtgttttttgggnatttttttaggattcagagctttaactcgt

SEQ ID NO: 52344 - DNA, 101 bp, rice(Oryza sativa)
  misc_feature (71): n=t or c
tcctatcctaataaaaagaagttgcagcaaaaattgcttatcagctatatgagatactttttgcaagctgnttttttggcccaaaactttacacccctgga

SEQ ID NO: 52345 - DNA, 101 bp, rice(Oryza sativa)
  misc_feature (71): n=t or c
caggaggaagctgagggccagaagagcccatagggggtccgccgaccctttgttgagcccaatccagtcanattttggccaagagataagggagaccgagg

SEQ ID NO: 52346 - DNA, 101 bp, rice(Oryza sativa)
  misc_feature (71): n=a or g
cagcggggtatttacctaagaggagaagtatgctgaaaaaaaaagagaagcacattcaagtcgtcgagagngagcctcgctcctgtctagatcacaaggtg

SEQ ID NO: 52347 - DNA, 101 bp, rice(Oryza sativa)
  misc_feature (71): n=t or c
gacgtgcacatactctgaaaattgctaaatctctgaacacctgggaagtactgaactctgcagaaaattgnagagggattgggcgccagagtggttttgcc

SEQ ID NO: 52348 - DNA, 101 bp, rice(Oryza sativa)
  misc_feature (71): n=a or g
acacaagtacggtcttgcctggtaagttagcacctggtaacctgcaatcagtttgtagcttcttgcatatnacatggacaccaaacatatgtttacagttt

SEQ ID NO: 52349 - DNA, 101 bp, rice(Oryza sativa)
  misc_feature (71): n=t or c
cacgacttcttcgagaagattgccatgagtgcctcaaattaaagaaaaaaaactatcagatagagcagatngtatatgaactcttcttttttattcttttt

SEQ ID NO: 52350 - DNA, 101 bp, rice(Oryza sativa)
  misc_feature (71): n=t or g
aaacattactggctcaagaggatggatgactcgagtttctggttgaattgactctgacgtgatcatacgtncccttatggctaggggtgaaaacgaccata

SEQ ID NO: 52351 - DNA, 101 bp, rice(Oryza sativa)
  misc_feature (71): n=a or g
cacctcaacactcaatccaatgtggtacatttaggggtagcatacggagcattataatacttgccccaacncattgtttagttgggaaaaatttttggatt

SEQ ID NO: 52352 - DNA, 101 bp, rice(Oryza sativa)
  misc_feature (71): n=t or c
aatctaatgcttggccttggcccgtgtttcccatttccaatccattagggcttctaaaggacccgttcggnagagagttagggcgatccacggacgtgggt

SEQ ID NO: 52353 - DNA, 101 bp, rice(Oryza sativa)
  misc_feature (71): n=a or c
tgttttcaagtgaaaggcatgggaagatgatgaaggctatcttaattagactctcagcaaacacttcacanactaaagttggtgaaggcatagtcaatata

SEQ ID NO: 52354 - DNA, 101 bp, rice(Oryza sativa)
  misc_feature (71): n=t or c
atttttcacatgatttgacgaaattacccctcagtcaatttcatcgttagaaataaatcggctgggaaagngagacgcatagggttagggtttccgtccgc

SEQ ID NO: 52355 - DNA, 101 bp, rice(Oryza sativa)
  misc_feature (71): n=a or g
taattacttaggaaatctctcaaactagggaatttctatacaactccaaactccaatattttcaaacatgnactccaattttcatgccgtgacaaattcat

SEQ ID NO: 52356 - DNA, 101 bp, rice(Oryza sativa)
  misc_feature (71): n=t or c
tccgtacgggcatcgacagttcatgcatgagacgcatcttgaagtattggaccagcagcagcgtagtatangtaggccgagtttagttccaaaatttatct

SEQ ID NO: 52357 - DNA, 101 bp, rice(Oryza sativa)
  misc_feature (71): n=t or g
ttcattaagcctcgtgaaaacctctaaacataataacgaagcaaaaccgttaattctccttcacatcaaanaagcaagatcggggaggggcccggtgaagc

SEQ ID NO: 52358 - DNA, 101 bp, rice(Oryza sativa)
  misc_feature (71): n=a or c
gataatctgagcagcgagaaaatgatgtcaaggtaaaagaaaaatggaaatacagcagttgtactaatatnttttgatgttgtaggaagacacaagtggtg

SEQ ID NO: 52359 - DNA, 101 bp, rice(Oryza sativa)
  misc_feature (71): n=a or g
acagcgcatttgtctcttgacaaaattgattcatcgagactcctgctttgctcgtattctttttctatatngtatatacttctagaacgagctaacgtttt

SEQ ID NO: 52360 - DNA, 101 bp, rice(Oryza sativa)
  misc_feature (71): n=a or g
gagcaaagctctaattaggtgatggcatgcatacaaaccgtagtcgctagttcacagcattggcgcatcancgcactgcatggacattgagaaagttaaca

SEQ ID NO: 52361 - DNA, 101 bp, rice(Oryza sativa)
  misc_feature (71): n=t or c
attttacccccattttttagggtttgaaattttaccccaactttttaaaaacgaaccagccgtttgccccnacttgtaacgcctgtttgatgggtcccacg

SEQ ID NO: 52362 - DNA, 101 bp, rice(Oryza sativa)
  misc_feature (71): n=t or g
agttacatcaggtattaggttgctctaaatgagacactccatgcctagtttaattagccggcgctgatttnattaatatgacaaaagtgctgtcctgtcct

SEQ ID NO: 52363 - DNA, 101 bp, rice(Oryza sativa)
  misc_feature (71): n=t or g
ttcagattaacaaccagagctggtgacaactgacaagtgacaacaccattggcacctctatagtataatangaagacagatctgttgaatgatcagacaca

SEQ ID NO: 52364 - DNA, 101 bp, rice(Oryza sativa)
  misc_feature (71): n=t or c
ttgcaaccactccaaattggattctttactcatgatacaaagtaatatggcctagccgagctatactagcnggctttacagaaatagatacaaaactacca

SEQ ID NO: 52365 - DNA, 101 bp, rice(Oryza sativa)
  misc_feature (71): n=a or c
acaatatattgtttgctctactctaagatatgaagacgggttcaaatatataatcccaataacgggttttngcacaatatgaactgtaacgaggttataat

SEQ ID NO: 52366 - DNA, 101 bp, rice(Oryza sativa)
  misc_feature (71): n=t or c
tttgatccacttgattttctcttttctgttttatcaaaaccggagcaatccatgaaacttgggataaaaangacgacggttaaataaagatgaaatccggt

SEQ ID NO: 52367 - DNA, 101 bp, rice(Oryza sativa)
  misc_feature (71): n=a or g
cacttcggaacgcaactagagttcatctcgccatcggagaaggcaagtaacgtagcggtggtttgctatanctttgacttgttatttgattttacctccac

SEQ ID NO: 52368 - DNA, 101 bp, rice(Oryza sativa)
  misc_feature (71): n=a or c
tgccatcatggatctcaaacctgacttctcttaacgttctcaagttcttcagttgtggcttgtccggaccnataccagcttccatagggaacttaacaaaa

SEQ ID NO: 52369 - DNA, 101 bp, rice(Oryza sativa)
  misc_feature (71): n=a or g
gatttgtagtgaaagtaggccatcatagaaggctagttaccttgtagtgttagctaggatagcagagggangttatggaggcaggatattggaaagcccac

SEQ ID NO: 52370 - DNA, 101 bp, rice(Oryza sativa)
  misc_feature (71): n=t or c
cgtgtaccgctgatgcaatttactcattattaaactagcgacggaactaaaataaatatttctccaaaaangaattggacaaattagaacttccataaatt

SEQ ID NO: 52371 - DNA, 101 bp, rice(Oryza sativa)
  misc_feature (71): n=a or g
gttgcacaaagtaaagagactagggagtgcttcaattgtggtaaaatggggcaccttatacgtgattgccncgctcctcgcaagcctagttatgggagagg

SEQ ID NO: 52372 - DNA, 101 bp, rice(Oryza sativa)
  misc_feature (71): n=a or g
gagaggtgccatgtttgatcggggggagggggtgcgactacaactttaggtgagcatgattccatgcatanctcttgacaaaggacaagaatcacttgtac

SEQ ID NO: 52373 - DNA, 101 bp, rice(Oryza sativa)
  misc_feature (71): n=a or g
aaggcatggacttagtggtaggggtggtggcagattcattgctcaccaccaccactactaatttttttagnagtatagatgtattattgttataatttttt

SEQ ID NO: 52374 - DNA, 101 bp, rice(Oryza sativa)
  misc_feature (71): n=a or g
tcgagtaaaccatacaacccccgagaccaaaatcccctccaaacccccgcgcgaaccaccaccaccacccnccggatccggcgccacgtcgtcccccccag

SEQ ID NO: 52375 - DNA, 101 bp, rice(Oryza sativa)
  misc_feature (71): n=t or g
tattttataggtaaaacttttatatatgtgtttctaacttcttaagaactaatatcgaaaaagaaactatnttaacgatatcttaaaatcaactttaaatt

SEQ ID NO: 52376 - DNA, 101 bp, rice(Oryza sativa)
  misc_feature (71): n=a or g
ttatgactgcacatataaactaactcagaaaagaaagaaagtgttccttaaattcattttgtgctggcccntacaccaaaactaaagcccatttaaactta

SEQ ID NO: 52377 - DNA, 101 bp, rice(Oryza sativa)
  misc_feature (71): n=a or g
tatcagtactgttctgcactgttcaaacagcggtgccgccgatccaacgtggaaccggctcatgaacagtntcaaaacagtgtgcatgtgcagcttggctg

SEQ ID NO: 52378 - DNA, 101 bp, rice(Oryza sativa)
  misc_feature (71): n=t or c
gaagtaaaatactttagctaaaatgacgtagtagtgcgtgtgcttgcttttgttttaagatagagaattanagtattattttgtatactatattttcctcc

SEQ ID NO: 52379 - DNA, 101 bp, rice(Oryza sativa)
  misc_feature (71): n=a or g
ccatattgtcagtagagggagcaacgaactcacgagattcttgctggccataatcttgaaagttggtggcnctggtacggctggtttctctgttggtagag

SEQ ID NO: 52380 - DNA, 101 bp, rice(Oryza sativa)
  misc_feature (71): n=t or c
actaaataataactacagtataatttagtttataacttttaaatagttaacttatgtactccctccatttnagattataagacgttttgaatttggtcaaa

SEQ ID NO: 52381 - DNA, 101 bp, rice(Oryza sativa)
  misc_feature (71): n=a or g
gagcgtcagggaacttacagtctgctttcaaaatataataacaaaacgatgtaatgcactgcaatatgacntcaaactcatagcttctctactatatatat

SEQ ID NO: 52382 - DNA, 101 bp, rice(Oryza sativa)
  misc_feature (71): n=a or g
cacaaataagagaagacggagcagtgcctttcttcttcgaacatgtacaggaaattcactaggaacatcantgatcacagttaaaacaccattcctctaat

SEQ ID NO: 52383 - DNA, 101 bp, rice(Oryza sativa)
  misc_feature (71): n=t or c
cggaggaagtatcatctatgcctaacaagttaaatggcttcatctttaaacaaataggctgtgttcttttntcccttttcccaactcacttccctcgattt

SEQ ID NO: 52384 - DNA, 101 bp, rice(Oryza sativa)
  misc_feature (71): n=a or c
tttgggttcggccgaacccgttgtggcgccgttgatcaccattttacacatgtacgctcttgattacttcntgatggcggttgtggggcagaatggtcatt

SEQ ID NO: 52385 - DNA, 101 bp, rice(Oryza sativa)
  misc_feature (71): n=t or c
tgaaagtcatcttacaatagcctcatgtacagcactggtgtagctttttttttcttgctgtagtggaactncttgaataaatcaaatgcattaggttcttc

SEQ ID NO: 52386 - DNA, 101 bp, rice(Oryza sativa)
  misc_feature (71): n=t or g
ttagaagtgaatatatagtatagccaaccaagcaagatagctagtttctagtactagagagatagagaganagagagagagagagagctaaagcaaagcaa

SEQ ID NO: 52387 - DNA, 101 bp, rice(Oryza sativa)
  misc_feature (71): n=a or c
ataagttttgttgcatagaaatatatgacaatgtaaatcttctaataaatactatctattgtaggttccanctaaaaaataaaaatgttattaatagttct

SEQ ID NO: 52388 - DNA, 101 bp, rice(Oryza sativa)
  misc_feature (71): n=t or c
ataaattccctatgcatagtctcggttgacaagattgatcctaataaggtcatattcttttctccaacatnggatgaagattaagatttttgtggcacgct

SEQ ID NO: 52389 - DNA, 101 bp, rice(Oryza sativa)
  misc_feature (71): n=t or c
gtcttccaaagaatgtctgttcgacttgtgtatgggaaccatgctttccttgcgtcactaccttgtgggtntgggcgcttgggagggttagcatattctgc

SEQ ID NO: 52390 - DNA, 101 bp, rice(Oryza sativa)
  misc_feature (71): n=t or g
accgctgtggatcaactcctcgcacgtcgcacacctttcctaccttcaactaggagtgggctttatagatntccaggatctacacactcttgggaggttgc

SEQ ID NO: 52391 - DNA, 101 bp, rice(Oryza sativa)
  misc_feature (71): n=t or c
cggatgcttgtgcttatcttacgcaggtcatttcagttttcgttcttgtcggagtcatttttgtcccaatngggcttgtttcgttgaaggcttcacgaaag

SEQ ID NO: 52392 - DNA, 101 bp, rice(Oryza sativa)
  misc_feature (71): n=a or g
aactcacagccaagaatgacgtatatagcttcggtgttattcttcttgagcttttaactggtaagaagccnttctcaaaagaaaggaagagcttgaccttg

SEQ ID NO: 52393 - DNA, 101 bp, rice(Oryza sativa)
  misc_feature (71): n=t or c
cagaaaaaattaatgacattgccagcttgattaataatgcaattatcatgcatggaataattaatctaccngacatcggcatcaatactctcatttcctag

SEQ ID NO: 52394 - DNA, 101 bp, rice(Oryza sativa)
  misc_feature (71): n=t or g
gtactggtagtggtaggcccgcctacatttctttttcgggctgtttccttttcaattatgaaaattttatngttcttaaaaaagtatcttgagatatctaa

SEQ ID NO: 52395 - DNA, 101 bp, rice(Oryza sativa)
  misc_feature (71): n=a or g
cccaccaccaccacgagtttgaccttaaagcacgaacctttacctgccccttgattccatcttgtatatancttttgtatcacttaaactctattctgaca

SEQ ID NO: 52396 - DNA, 101 bp, rice(Oryza sativa)
  misc_feature (71): n=t or c
tgtggatatttgctcgattttggagaggaggagagagagaggagggcgccacgccttctcaaccaagaggngcgaggaggaagaaggaatggcctggggcc

SEQ ID NO: 52397 - DNA, 101 bp, rice(Oryza sativa)
  misc_feature (71): n=t or c
accatagcatcatggtgttgcaaggagagataactagaccacgatgatgttaaattgtggtcacattttgnatgttcatttagacatgtgaattattggga

SEQ ID NO: 52398 - DNA, 101 bp, rice(Oryza sativa)
  misc_feature (71): n=a or g
accaaaccaaccactctcggcttatatgtattccccacccaaatacacacgaatcatccacaatacatccncaatccacaaatcaagcacaacaaaatcat

SEQ ID NO: 52399 - DNA, 101 bp, rice(Oryza sativa)
  misc_feature (71): n=a or g
acattctgagaagcaactgattgatagcgagtttctcaaaatatagaaaagctaggtttttcaagttgtgncttctagtttattttctggattttacaatt

SEQ ID NO: 52400 - DNA, 101 bp, rice(Oryza sativa)
  misc_feature (71): n=a or g
tttggttgcctttgctatcctaatcttagtgccacgactcatcataaacactctcctcggtcagctgcctntgttttccttctctaaccggcctctcacaa

SEQ ID NO: 52401 - DNA, 101 bp, rice(Oryza sativa)
  misc_feature (71): n=t or c
tttgtgtaactcctatgagatcaaaaaagtttgcactaaaatgcacggggtatctcctttaaaaaccatanaaaatcaccaaacacgtatagtttatttat

SEQ ID NO: 52402 - DNA, 101 bp, rice(Oryza sativa)
  misc_feature (71): n=t or g
ttgccgatttgacggcagtaacagaatgactgcgaattcactgttggtgtcatctgtggactgattagaanatgaccattgtttgcttcccatcctcgatg

SEQ ID NO: 52403 - DNA, 101 bp, rice(Oryza sativa)
  misc_feature (71): n=a or g
tgatgaatctgaatcatccaaagtttttacttgtgtaccactgtacatagaatcccaaaagtaccttttgntttgcagaattttaattttgttaagaaaaa

SEQ ID NO: 52404 - DNA, 101 bp, rice(Oryza sativa)
  misc_feature (71): n=t or c
acgcatcgcatcgcacccaaacccatcgcctctcgaatcgaaagagaccaagcgcacggaaaagcctcccnccctaaacaacacgacccatctcctcctcc

SEQ ID NO: 52405 - DNA, 101 bp, rice(Oryza sativa)
  misc_feature (71): n=t or c
actaataaggaagaaagtactcttgtcatgtacatatgtctatttgatcctaaacataagagcaattttanggtacttaaggaggtaccatgaggtaccac

SEQ ID NO: 52406 - DNA, 101 bp, rice(Oryza sativa)
  misc_feature (71): n=a or g
gataggaatttgttgagtctaagggatgacaggtgggcccgaacatttttttttatttgctgactgcactnccacgttggcgccacgtgtgcaagcttaag

SEQ ID NO: 52407 - DNA, 101 bp, rice(Oryza sativa)
  misc_feature (71): n=t or c
gaaaaagaaaaagttagcctagctctctcgccttcggttttggcaaccttctctcgcactctctccaagcnagatttctgatgactaataactctcgctgg

SEQ ID NO: 52408 - DNA, 101 bp, rice(Oryza sativa)
  misc_feature (71): n=a or g
cgtctataaaaagaattcaatcttagcaataaatctggatgcatacatgttcatgtttgttaataagattngatttttttttgacgaaaggtagatcggta

SEQ ID NO: 52409 - DNA, 101 bp, rice(Oryza sativa)
  misc_feature (71): n=a or g
cagcttggtgatgagtgtgaggaaagtggcaggaccatcgaagatgattgagaagacgtcgacggtgaccnaagagaccgcgacgagtgtgaaggcgtcgc

SEQ ID NO: 52410 - DNA, 101 bp, rice(Oryza sativa)
  misc_feature (71): n=t or c
tagttaaggtgaaattcattatggcaattctcttggatatattttctttttgaaaatcctgagctgcggtnaggagtctgatcatctcaggttagcatgtg

SEQ ID NO: 52411 - DNA, 101 bp, rice(Oryza sativa)
  misc_feature (71): n=a or c
aattctaatccaacatctaggcatgttacatcccaagttaacaaagcaaaatggcatacaaataataaggntgagaacagtaggtaaaaagcccataccgt

SEQ ID NO: 52412 - DNA, 101 bp, rice(Oryza sativa)
  misc_feature (71): n=a or g
aataaattgaggaaactaaacaaagagtatattcgtcgcataccactaaaaaattttgaaataaatgaagnaacctaaccaaagagtaaattaaagtacta

SEQ ID NO: 52413 - DNA, 101 bp, rice(Oryza sativa)
  misc_feature (71): n=a or g
tcatatagttccaagagtgaagatcaagattggatataacacatgaccatgaaaatagtaggttccccttnttcaatgttcaactaatgcagcgaaaatta

SEQ ID NO: 52414 - DNA, 101 bp, rice(Oryza sativa)
  misc_feature (71): n=a or c
ataaagaattaaaaaaggaaaacacttacatgggccaaaaccgaccgaaattaaaaaaggaaaacacttantgattgaaattttgatgatttcaatcagaa

SEQ ID NO: 52415 - DNA, 101 bp, rice(Oryza sativa)
  misc_feature (71): n=a or g
tgtcggcttgctgtgaaactcgagctagctcgcgagctaatacaaccatttcatcacttcagagatagcanacagggaagaacatattctgaaaacatttg

SEQ ID NO: 52416 - DNA, 101 bp, rice(Oryza sativa)
  misc_feature (71): n=t or c
tctcaatccacacatcctgtaaatcccaaattatatggtttggcccgttgtaaatcacttccaacttttcnatcgcattaaaactttttcttcaaacttcc

SEQ ID NO: 52417 - DNA, 101 bp, rice(Oryza sativa)
  misc_feature (71): n=t or g
tgtttctatttacagtacaaacgttttggttcatttgctatattatcttttctaaggcgagaatttcacanaatctttttagggattctttttacataaaa

SEQ ID NO: 52418 - DNA, 101 bp, rice(Oryza sativa)
  misc_feature (71): n=t or c
ttagtgcttacatcttcatgacactctaatcatgtctatgtaaaccaccgatgtcgaggagtgatcctctntagcgggagatcgtgagatccccctttctg

SEQ ID NO: 52419 - DNA, 101 bp, rice(Oryza sativa)
  misc_feature (71): n=t or c
ggatgccacatatttagatgcaacatctcctcttaatcttaataaaattttttgggccttttcttcaccgncagtccggtgaaaaaaaaacaaaaacaaaa

SEQ ID NO: 52420 - DNA, 101 bp, rice(Oryza sativa)
  misc_feature (71): n=t or c
gcagctggctaccttacagagtacgtagaagttgcagcatactggggtactatatataaatagagagctgntacaaaacaggatcccgttgtaacgggata

SEQ ID NO: 52421 - DNA, 101 bp, rice(Oryza sativa)
  misc_feature (71): n=a or g
cgtaatacgttatcagcacgacgttctaccggagatcaagaaagaagaagggtaagaaactcgcaaatccnttttgcatctcgccgatctaatcgcgaaaa

SEQ ID NO: 52422 - DNA, 101 bp, rice(Oryza sativa)
  misc_feature (71): n=t or c
acgacagggcatagtggaccaatgaaaatacgaaacttttttgcgagctgtattgcaagcaaattgaaaanggcaactgcataaggggaagcatgaccaaa

SEQ ID NO: 52423 - DNA, 101 bp, rice(Oryza sativa)
  misc_feature (71): n=t or c
tccagcaggcggcaggggcgacatgctcatcggagattcggcgtacgtgctgacagacgatccaccccatnggagaagcgtagatggcggcatcacggccg

SEQ ID NO: 52424 - DNA, 101 bp, rice(Oryza sativa)
  misc_feature (71): n=t or g
cctgcgctagcagcttaggaggagaaagaggatctcgagcttgtgttagtgtctcagctgcataggaacgncagctgcctctgcctcgagattgctcaccg

SEQ ID NO: 52425 - DNA, 101 bp, rice(Oryza sativa)
  misc_feature (71): n=t or g
gctcaccgccatacgcaccagcaattgagccagagggggacggatggcgagttcaggcatccctttatctngcatctgcgccgccgcccgacacacgtgag

SEQ ID NO: 52426 - DNA, 101 bp, rice(Oryza sativa)
  misc_feature (71): n=t or c
tgccaacaatattactctatgccaattgcaatttaattggactttctgaaacaaggaaaaaacatattgtnggtgatatgggaccgagggtacctatgctg

SEQ ID NO: 52427 - DNA, 101 bp, rice(Oryza sativa)
  misc_feature (71): n=a or g
cggcaatgatgtaaattgtcacgacgtttgcagacaagaaccactggcatctcatcaccgaacaaatttcntcagctccgggacggttttgcctcggcgtt

SEQ ID NO: 52428 - DNA, 101 bp, rice(Oryza sativa)
  misc_feature (71): n=t or c
aaaaaaaaccaaattcccataataaaggggttccaaaatatgtgtgatttgttgcaatagtagataggagnatagatacggtaggacaaggcctgcatgca

SEQ ID NO: 52429 - DNA, 101 bp, rice(Oryza sativa)
  misc_feature (71): n=a or g
cgatgcctgaatgaattacagtaattcagacgcatgcagatgctgagatgcagatgtgtagatggttaagnccctgtttagatgggaataaaacttttaag

SEQ ID NO: 52430 - DNA, 101 bp, rice(Oryza sativa)
  misc_feature (71): n=a or c
aattctatgtgggcccatcttatgactaaattctaatcataacattgtgagtacagttttaacaatggttnactattcatagggcccaccttaagattaca

SEQ ID NO: 52431 - DNA, 101 bp, rice(Oryza sativa)
  misc_feature (71): n=t or g
gctgtttgaaccaaaccaagatagcgcagctcgtgctgttttttttttttttggaaggatttttagtccanatgcagtctgggccgcaatctatactagtg

SEQ ID NO: 52432 - DNA, 101 bp, rice(Oryza sativa)
  misc_feature (71): n=a or g
aagaaacaagagagtgtatagaacgcgttcacaaagacagggtgaagcagaacgcgttcacaaagacaggntgaagcactgaaattcgactataaaagtaa

SEQ ID NO: 52433 - DNA, 101 bp, rice(Oryza sativa)
  misc_feature (71): n=t or c
aatacaactaatgttttgcagtactaattataaatcttatactgtaaatttgaaaagttaatactccctcngtcctaaaatataagcatttttagtgtgtg

SEQ ID NO: 52434 - DNA, 101 bp, rice(Oryza sativa)
  misc_feature (71): n=a or g
actgcaccctgtcacctcctgcccatcccgaacgacgccacgtcaccctctatgcacacaagaatccgtcntacgaattgtgttactaccttcgtcgcaga

SEQ ID NO: 52435 - DNA, 101 bp, rice(Oryza sativa)
  misc_feature (71): n=a or g
tattaatagagggttcggcatcaagctattgctgtcgcaaccgcatcaataaaaaatcgctataacacttntagaaaaaccattttttccagacgacggca

SEQ ID NO: 52436 - DNA, 101 bp, rice(Oryza sativa)
  misc_feature (71): n=a or g
aaacttaaaagagaaactattttgatcaccttcatcttttctttatccttccctgaaaggcaccaaacatngacaataaagtttactacattactgtaagt

SEQ ID NO: 52437 - DNA, 101 bp, rice(Oryza sativa)
  misc_feature (71): n=a or g
cgccactgcgtacggcgattgctgtgcgcgtgtatcagtggcctttactatgggtctcctgcaatagttcngctgcgagcacgtcgccgagttccctaact

SEQ ID NO: 52438 - DNA, 101 bp, rice(Oryza sativa)
  misc_feature (71): n=a or g
actccaccgttctgctcgaagaatctttgctttgttctgatgagcttcctcttctggagccccaagtacanccaaaagcacatgaacaccgacaagaacac

SEQ ID NO: 52439 - DNA, 101 bp, rice(Oryza sativa)
  misc_feature (71): n=t or c
cgttttccttttcaataaagaaagaactattgcttttagtacgaaagagtcttgtacttgggtcgatgaanctcctggttatattctaagcgctttggcaa

SEQ ID NO: 52440 - DNA, 101 bp, rice(Oryza sativa)
  misc_feature (71): n=a or c
cgttgcaattgaataatagtgtttctagaaagaagccaaatgaggaggttaacagcactcacattgtcaanataatttacagtttagactaaagccttacc

SEQ ID NO: 52441 - DNA, 101 bp, rice(Oryza sativa)
  misc_feature (71): n=a or c
tcggaatcggctcgccattcggcgcataacagtcacacatgacctacatttacagcatggttaaaaaggantcatgaacaaaaattcatgccagaagcttt

SEQ ID NO: 52442 - DNA, 101 bp, rice(Oryza sativa)
  misc_feature (71): n=t or c
tacggatgcccctgatgatcatgctttatcctgttctagtgatgggcttgcaaggtcttgatagatttctntgctgggttggtggggatcatgtgatggca

SEQ ID NO: 52443 - DNA, 101 bp, rice(Oryza sativa)
  misc_feature (71): n=a or g
gtgatatgaatctccaaaggttgatgtagctgctgagcattgtagtgtttaagaggttaagctgtgtgtcntgctgaatttattgcaggcgagttttattg

SEQ ID NO: 52444 - DNA, 101 bp, rice(Oryza sativa)
  misc_feature (71): n=a or c
ccgtctcagtaatggtgcgaggctaaccaggattagatctactgttttatcgaaactgctaaatttaactnaaaaaaaaagaaaccgctaaattaatcata

SEQ ID NO: 52445 - DNA, 101 bp, rice(Oryza sativa)
  misc_feature (71): n=a or g
attggagtgaggaataagtttggcttgctaaatcgactgaaagctgactatatgggtatttagagagtttnatttggagagacagttggagatgctcttag

SEQ ID NO: 52446 - DNA, 101 bp, rice(Oryza sativa)
  misc_feature (71): n=t or c
cacgacgcaacaaaaaaaccaagaggatagtagatgagaaatgcgagatgggctttagctgctttactaantgagccattgcccgggagatgctttgcaac

SEQ ID NO: 52447 - DNA, 101 bp, rice(Oryza sativa)
  misc_feature (71): n=a or g
ccatcccctgacgagagggaactagtcgttaggatttggagagtctgttggagtgtgtgcaacagatatgnaaaggaatctttttgtctaattggccaaat

SEQ ID NO: 52448 - DNA, 101 bp, rice(Oryza sativa)
  misc_feature (71): n=a or g
aaattgattgccacgacgacttggcaatgccacggaatctccgtcctcttcacctccaccaaacctcttangagattccagcgtttgtgtccaccacgcaa

SEQ ID NO: 52449 - DNA, 101 bp, rice(Oryza sativa)
  misc_feature (71): n=t or c
tctgctgtacgtcatgccgcagatcatcgcgcgcccattgcctaggtcggtgtaccgcctatgttgcctcngttacccgtctacgccgccgccgcatcctc

SEQ ID NO: 52450 - DNA, 101 bp, rice(Oryza sativa)
  misc_feature (71): n=t or c
tggcgtgtctggactggaaaaaagttattagtcgagctagtgagattaattatttggtagtacgttttttngcttttgtactgatagagaggcatgttatt

SEQ ID NO: 52451 - DNA, 101 bp, rice(Oryza sativa)
  misc_feature (71): n=t or c
aaaaatctagggcgaaacagaagaaattgagcgcgcgaacagctgatccggcggcggatcgaggcgggggnagagatccttacacttagcgcacaccatcg

SEQ ID NO: 52452 - DNA, 101 bp, rice(Oryza sativa)
  misc_feature (71): n=a or g
ctgcagcactgtgtccttcgttagatatcatatcgctgcgccttatatagcctcacgaacgggctcagtcntgatctcgcacgcgactaggattactcgcg

SEQ ID NO: 52453 - DNA, 101 bp, rice(Oryza sativa)
  misc_feature (71): n=t or c
tcaaagagcaagaactgaatcctaaatcctaatccaagttgtcaatcacaagctaaaagtattaaggaaantgatgagcaccttttttttttcaattgtat

SEQ ID NO: 52454 - DNA, 101 bp, rice(Oryza sativa)
  misc_feature (71): n=t or c
cctctgcgtcctctcgcacggtggcgtatggcgacgactactctgccccatcctcaccttccaccggcggngcaaggcggcggaccatgccgtgctccatg

SEQ ID NO: 52455 - DNA, 101 bp, rice(Oryza sativa)
  misc_feature (71): n=t or c
ttatggatccaattaacctaataaaaatactgctcaaaattttgcataacacacaaatttaatagcatcgntttgtgaaattgatggtataaggacatcca

SEQ ID NO: 52456 - DNA, 101 bp, rice(Oryza sativa)
  misc_feature (71): n=t or g
ggactagtagtacggtgggttactgtggacatgtttggaggagtttttaggtgttgcagctccttctaganaatctctatatcccaaatagttcagattgt

SEQ ID NO: 52457 - DNA, 101 bp, rice(Oryza sativa)
  misc_feature (71): n=t or c
cacggtggcaggaggacgatgccagccactctagcgacctaaaaagaaccgtttcttcgataagttttccnagggatctatttacgaaataagtttttcaa

SEQ ID NO: 52458 - DNA, 101 bp, rice(Oryza sativa)
  misc_feature (71): n=a or g
atgtttctgagaaatgtcatgtgtgttcaagatgagaaattggtgaatccaatatgctgtaattttgttgnaaattttcacagctgtgatgggcggtgcga

SEQ ID NO: 52459 - DNA, 101 bp, rice(Oryza sativa)
  misc_feature (71): n=a or g
gttcaatatgttcaaagagtgcacttgccttgatcccagtattgtccttgcacagcgtcttctggagcaanctgctcttccgctccaacatctacacgatt

SEQ ID NO: 52460 - DNA, 101 bp, rice(Oryza sativa)
  misc_feature (71): n=t or c
cctaagtaaaccaagtacgatatgagggcgacatttttcgactatgtaatcgataacccaaaaggcttacngagggggtgggcgccttccggcggttgccg

SEQ ID NO: 52461 - DNA, 101 bp, rice(Oryza sativa)
  misc_feature (71): n=t or g
cattcagcttatttataaaaatattactcctacgtagacatcatcatttattttgctatgacctattgaangtacagaggactttaaacatgacttatata

SEQ ID NO: 52462 - DNA, 101 bp, rice(Oryza sativa)
  misc_feature (71): n=t or c
atcacaagaaagccattgccatagggttctcaattggaggaggtctcatattggtgctcctgttgtggtcnattctctcatggtggaagtggagaaaaaca

SEQ ID NO: 52463 - DNA, 101 bp, rice(Oryza sativa)
  misc_feature (71): n=t or c
tgagtgtaagcgatagggaggttgaccggtcgcttttctcgccctttatccacgcacgcggatacatcganaggatagggggagaaaacggtacggtttcc

SEQ ID NO: 52464 - DNA, 101 bp, rice(Oryza sativa)
  misc_feature (71): n=t or c
cagacattgctccatgcaatgtcatcctcacctataatgactccacgagtaccggttccgatgaaacgttnacgggaagggagcgagaaatattccatgct

SEQ ID NO: 52465 - DNA, 101 bp, rice(Oryza sativa)
  misc_feature (71): n=t or c
aacacacactgcctagcagtttgggaagcgtgcacgcaaaaaagatagatttttttctctctatccctacntgtagaaggtgctccatgtattattaggtc

SEQ ID NO: 52466 - DNA, 101 bp, rice(Oryza sativa)
  misc_feature (71): n=t or c
actccctccgtcagataatatagcatctaggactaatgagacatcacctgttacgatgcactcatctagtnctatgttgttatattttcgaacggatggag

SEQ ID NO: 52467 - DNA, 101 bp, rice(Oryza sativa)
  misc_feature (71): n=a or g
ttatggagatagaaaccgtggagtcggagtacctgatcaacgactgcctgacgatgcactgcgacgtggangttgtcaaggagttgaagaccggagcaacc

SEQ ID NO: 52468 - DNA, 101 bp, rice(Oryza sativa)
  misc_feature (71): n=t or c
cgtgcggatccggcgccgacaacgacggatgacggtgggagcggtgaagtggccgacgacggtgacgaatncggcagcgcggaggccggctggattgggcg

SEQ ID NO: 52469 - DNA, 101 bp, rice(Oryza sativa)
  misc_feature (71): n=t or c
gcgtacaacgatggggaaaagatgaggaggagatttgctgcggcgggggtggaggcagcgatgggaataanagctgcgaaggctgtggttatatatgggac

SEQ ID NO: 52470 - DNA, 101 bp, rice(Oryza sativa)
  misc_feature (71): n=a or c
attaatatgtgatctcatatactgattcctagtaatatgttatacaatatcttatactcccttccgtttcngtttcaggttataaaacgttttgactttgg

SEQ ID NO: 52471 - DNA, 101 bp, rice(Oryza sativa)
  misc_feature (71): n=a or g
actgcgaggagctagaaccggcttcggactttttacttggggactttccaactccatcttcggaaggtatnggcacatcatgggatcctatcttgatggta

SEQ ID NO: 52472 - DNA, 101 bp, rice(Oryza sativa)
  misc_feature (71): n=t or c
ttctcaatctcctaaaattgattgagatcttttgatccacttgatatccactttccgtttttcccaaaatnggagcgaatctgtttaatctcagtcgttgg

SEQ ID NO: 52473 - DNA, 101 bp, rice(Oryza sativa)
  misc_feature (71): n=a or g
gtaaagccgctcgatctcccttgccagcctgccactccttcatttcgctcggtctagattgagagagaaanaaagacaaatggcacatgtggagggctgag

SEQ ID NO: 52474 - DNA, 101 bp, rice(Oryza sativa)
  misc_feature (71): n=a or g
atcttttacacacgctagctttttgaaatattttagaattttgtaagtagtaactgttgtacaatttttcnaagttgtaacatatataatttatacaattt

SEQ ID NO: 52475 - DNA, 101 bp, rice(Oryza sativa)
  misc_feature (71): n=a or g
ttccctttaccaaactataggtttgtgctttgcaaatttctttcagctttgtgtcgttgaattctagtccntggtcgctctgaatcaacacaaatcggagt

SEQ ID NO: 52476 - DNA, 101 bp, rice(Oryza sativa)
  misc_feature (71): n=a or g
gcgataattgtgggacgatagatcattctattacttgctcaatcttaaaatattaaaatattactacttangatgatatactttaataagtcaaatcctat

SEQ ID NO: 52477 - DNA, 101 bp, rice(Oryza sativa)
  misc_feature (71): n=a or g
ttcgagtatacccataaatagctgggtatagcatatctattgttaacccgctaggtatcgggctagatagnggtgttgtctataacgtacgaattattgta

SEQ ID NO: 52478 - DNA, 101 bp, rice(Oryza sativa)
  misc_feature (71): n=a or g
tcgatttatatatactcggtaaaagaacaacattatggcttcttttagtgcatctggcaaaaaatatcttnttatcatgcatgctatatttttctcctttt

SEQ ID NO: 52479 - DNA, 101 bp, rice(Oryza sativa)
  misc_feature (71): n=a or g
aaccttggccaagcacaaacacacaagaacatgagcctagggatgtaattcttgttcttacaagtgtgatntggttcatcttcctcgggtagcaagtaata

SEQ ID NO: 52480 - DNA, 101 bp, rice(Oryza sativa)
  misc_feature (71): n=a or g
tggcactaacttcattcttttttttattcataatatcttgattccctactctctctatcacattttaaacntagttataagtttccgtgtctaattttaat

SEQ ID NO: 52481 - DNA, 101 bp, rice(Oryza sativa)
  misc_feature (71): n=t or c
catataggtaaatcccattgccattgtcaaatgatagtccgtcaatagctaagatcctactgcgataatanaaggatatacgtctagatgtaatatagaga

SEQ ID NO: 52482 - DNA, 101 bp, rice(Oryza sativa)
  misc_feature (71): n=a or g
gcggcgccctataatttgggatggagggagtataatttagccccacaattaacaaacagctcatatgtgcncttttttaggttggcacaagtaataaaaag

SEQ ID NO: 52483 - DNA, 101 bp, rice(Oryza sativa)
  misc_feature (71): n=a or g
ttaatgactggtttcaggattgaagtaattgtcccgaccatgcctggttttgtctaacaaagagcagttgnagatcacacactactaaaaacagaagtgct

SEQ ID NO: 52484 - DNA, 101 bp, rice(Oryza sativa)
  misc_feature (71): n=a or c
acgatccgtgcgggcatccataatgtagtacggtcctactacctccgtgcgggcatccataatgtacgtantccctccgtcccataaaaaatcaatcttgt

SEQ ID NO: 52485 - DNA, 101 bp, rice(Oryza sativa)
  misc_feature (71): n=t or c
gggatgggtgaaaaaaaaattattttgaaacagatggaataagcaactataatttcaaaagtaaccctcangtctagttaatattaaaattttaatatttg

SEQ ID NO: 52486 - DNA, 101 bp, rice(Oryza sativa)
  misc_feature (71): n=t or c
aggccccctcccctgacgagccccttccccctctcttttttctcagggcggtgacagcgcgatgcccccgncccgtcatcttccccgtcttcggtggctcc

SEQ ID NO: 52487 - DNA, 101 bp, rice(Oryza sativa)
  misc_feature (71): n=t or c
aagaatttagtaagaaaaagttagtacgtatagccttttcctttcttttaaggtgaatatgactgccaggntttgccaagcagtataaattttataaataa

SEQ ID NO: 52488 - DNA, 101 bp, rice(Oryza sativa)
  misc_feature (71): n=a or g
tgtttagcggtttgaaaagcgtgccacgagtaggagagtacttatgataagatatagactcaatcatgagnatgaatttggacatacactatgctatgtct

SEQ ID NO: 52489 - DNA, 101 bp, rice(Oryza sativa)
  misc_feature (71): n=t or g
tgtatgatggtggttctctattttctgttcaaaatacaaaagagggatatgtacatgtactacctgaaagnactgtaaatgcatcaaaagaggatggtgta

SEQ ID NO: 52490 - DNA, 101 bp, rice(Oryza sativa)
  misc_feature (71): n=t or c
aacaacatcgtcttcaacttgatcgtgctctacaaacccatgtaagttttgtttgttcactgctctagatntaattttataatgaagtttcctaacttatg

SEQ ID NO: 52491 - DNA, 101 bp, rice(Oryza sativa)
  misc_feature (71): n=a or g
gattggttcctggacgggtgagttctttgcttccctctttgctttccctttgttttcgctgatttcgcccngattgcctcccatgatgcattgatgcttag

SEQ ID NO: 52492 - DNA, 101 bp, rice(Oryza sativa)
  misc_feature (71): n=t or c
gtcatgttgacttgaatcacacccaagtactgtatattgaaactacaagttggcgttctatctgagttgcngcagaagggaacagaaatacagaatcactg

SEQ ID NO: 52493 - DNA, 101 bp, rice(Oryza sativa)
  misc_feature (71): n=a or g
ggattctcacagaggaagaacatcaacggcaacttttggaggagggcatagaaccgcagcaatccgagctnctagaggagcacaatttccaaacaagcacg

SEQ ID NO: 52494 - DNA, 101 bp, rice(Oryza sativa)
  misc_feature (71): n=a or g
ttgatgctaattacgtactgtacatatactattgatgctttgaacattaacatatatatgttaatttatcnttcccaccgtatattttcgtaagacctacg

SEQ ID NO: 52495 - DNA, 101 bp, rice(Oryza sativa)
  misc_feature (71): n=t or c
tcactaatcaaatcgagccgttggacaatgtcgctgtttgattttgcgagaccattcggtctcactcttcnattccgcgaaaccgcgcagtctcgcgcctc

SEQ ID NO: 52496 - DNA, 101 bp, rice(Oryza sativa)
  misc_feature (71): n=t or c
tgattttaaccctaaggccctttacttaaattcctagcatgctcacaatttaccgaagataccaccggtanatcattccaatggaatagctgatgtcatga

SEQ ID NO: 52497 - DNA, 101 bp, rice(Oryza sativa)
  misc_feature (71): n=a or g
tccaaagattccatgtagtattgcactatttctgcacagcagcctccatccatggcaccatcagagtcagngtatacttgtttgttgattctcttcctttt

SEQ ID NO: 52498 - DNA, 101 bp, rice(Oryza sativa)
  misc_feature (71): n=a or g
cattaaacctctctaagcaattgtgattagtaaaaaactagtggctaacccgttgttgaaacatgaattcngcaataataaaaggggtagcgcacgagacc

SEQ ID NO: 52499 - DNA, 101 bp, rice(Oryza sativa)
  misc_feature (71): n=t or c
ggttgtaatattatctttgtgtctgtgtgtgctagtttgatcctggactagcacttatacacaagagatcntattcgagtccttacaaatctatctatgcc

SEQ ID NO: 52500 - DNA, 101 bp, rice(Oryza sativa)
  misc_feature (71): n=a or g
gacaaccacgcaacagattatccttgtttttagagtaaattgtatatttgtattcatggtacatgaacttntatagtgggtgcaaatagatacaacaactt

SEQ ID NO: 52501 - DNA, 101 bp, rice(Oryza sativa)
  misc_feature (71): n=a or g
aaatgttccatccaaagtggctgaaatagagcaagggcaaaatagatctttcaatcctctgttagtctccnttagtgctgattccatccaaagtggcgcat

SEQ ID NO: 52502 - DNA, 101 bp, rice(Oryza sativa)
  misc_feature (71): n=t or c
gtggtaggtacgtcgacagagagatgactgtggaggtgctcatagggatagggtttacatgtacgtgcgcnaacacttataccgtgtatgtaacaatatgt

SEQ ID NO: 52503 - DNA, 101 bp, rice(Oryza sativa)
  misc_feature (71): n=a or g
attgtactattatctaaaaatttgagttgccttgcttggatagacattactatttggtgatgtctggattngaatttggaagtggctgtagagcaggtaca

SEQ ID NO: 52504 - DNA, 101 bp, rice(Oryza sativa)
  misc_feature (71): n=t or g
tctttcctttctattagcgtacctatattgcatcatgtttccttatttcatcttgctattttggcactttntattcccacagagagtttgtacgagccaca

SEQ ID NO: 52505 - DNA, 101 bp, rice(Oryza sativa)
  misc_feature (71): n=t or c
agagtatattatatatagtataggacctcgtatattcggtagttaggggatctttttattctattggtggntgttagtttgtgtctgcttttagctttgtt

SEQ ID NO: 52506 - DNA, 101 bp, rice(Oryza sativa)
  misc_feature (71): n=a or g
tggaggtgtaggatgggtaacaccacagataaagtgagataagtgatgcatcttagattagagttacagtnctactctattcgtctcagaaaatgcactca

SEQ ID NO: 52507 - DNA, 101 bp, rice(Oryza sativa)
  misc_feature (71): n=a or g
tctcctccaattatcttcaatcctctccaaagcgaacaatggcttaggactttgcaacacacttgcgcacngtgtaaagttatgtggaaacattttgttag

SEQ ID NO: 52508 - DNA, 101 bp, rice(Oryza sativa)
  misc_feature (71): n=t or c
ttctggtttttttagtaggtgttcatttttaaataaactaatacctataatatgagtgtatgtgtaggttngtaaaaactgggacctataatatattatag

SEQ ID NO: 52509 - DNA, 101 bp, rice(Oryza sativa)
  misc_feature (71): n=a or g
caatgttggccttaccaaaatttggtatgattttggcatgccaatttttgttaaggccaacatgtgtttgnattgaagccaaattaaactaatttggctat

SEQ ID NO: 52510 - DNA, 101 bp, rice(Oryza sativa)
  misc_feature (71): n=a or g
aatcataattttaagacagaatatattatatcctaagacaactaatctggataagactttgctatcttagnacgtatggagtatatatctatctataatct

SEQ ID NO: 52511 - DNA, 101 bp, rice(Oryza sativa)
  misc_feature (71): n=a or c
tgtcccacgactcgtaggtgtacttgtggttgacgtactaaaaaaatcgtgtttgatctcagattatagtntcagagcaatgatcaaataaaaatcatgtt

SEQ ID NO: 52512 - DNA, 101 bp, rice(Oryza sativa)
  misc_feature (71): n=a or g
cccgcctccgcaggtcacgcccaaagtacctagatcctgactgtttcaggtccttcgtggcggtggcagcngcgctggcgagcgtggattctttgatgccg

SEQ ID NO: 52513 - DNA, 101 bp, rice(Oryza sativa)
  misc_feature (71): n=a or c
agttaagcggatacaaatcagcagtctcatatacattattgttagaacaaagatttctgggatatatattncttaagcgaggttaatggttaaaatttgga

SEQ ID NO: 52514 - DNA, 101 bp, rice(Oryza sativa)
  misc_feature (71): n=a or g
ctttcctaagcctaccattaggtattgtttttggatagaatttagttcctagatatacacacatgttcccncagattcgatacccttggaatactctaagg

SEQ ID NO: 52515 - DNA, 101 bp, rice(Oryza sativa)
  misc_feature (71): n=a or g
tggagcaggtccttccagagtggtggcagcaccgaagcagggaagcctgaagctggcgaggcagtcccctncaagtagaggtggcccagcctcgaaaggcg

SEQ ID NO: 52516 - DNA, 101 bp, rice(Oryza sativa)
  misc_feature (71): n=t or c
gatttcttgcgtgtttgactcaccatcgtgtgcggtactacctccgtctgcactattcacgttaaacgttnaacgtttgatcgttcgtcttatttgaaatt

SEQ ID NO: 52517 - DNA, 101 bp, rice(Oryza sativa)
  misc_feature (71): n=a or c
gatggttttaaatagaaaccgcaaaaggaaattaaataaaaggagaggttttgagttagttttaggaagtntctctaattataatattctaggtttaagaa

SEQ ID NO: 52518 - DNA, 101 bp, rice(Oryza sativa)
  misc_feature (71): n=a or g
gcatagtgaggatgacacggtagagcagcgacctcgcagcaggccccgcaagtgaatcctgcaaactcacncgtaatagggacgcaaggagcggcggcgta

SEQ ID NO: 52519 - DNA, 101 bp, rice(Oryza sativa)
  misc_feature (71): n=t or c
aatgagaaggaactttgcaagagtgctagctgctaggaatcagaaccctctatccgctagcttggatcctncttttatagattaaggggtatccacagtgt

SEQ ID NO: 52520 - DNA, 101 bp, rice(Oryza sativa)
  misc_feature (71): n=a or g
ctattttttttcattaatagacttggactttgctgaatagggcttctttgaaacatcggattgaaaaaaanaagggagaaaaaacatgtgaattctactgg

SEQ ID NO: 52521 - DNA, 101 bp, rice(Oryza sativa)
  misc_feature (71): n=t or c
acacagatatgggtagaaacacgtttggtttctagcgcaataattttattctaaacaaaactattttttanatactcctcctctcaaccaatcgtaaccat

SEQ ID NO: 52522 - DNA, 101 bp, rice(Oryza sativa)
  misc_feature (71): n=a or g
tactttgccacaactttggcaagctattttggccaacttagcctagtgtttgcttagttgccacatctttntcatgtcacactttttgattttgtgaccct

SEQ ID NO: 52523 - DNA, 101 bp, rice(Oryza sativa)
  misc_feature (71): n=t or c
ttgcggggtttctgggggtgaaagtgaaacttgggttggcggctccaccccatatataggcgccacaggcnggtgtggaacagcggcgcgcgcatgctctc

SEQ ID NO: 52524 - DNA, 101 bp, rice(Oryza sativa)
  misc_feature (71): n=a or g
tgtaattagtccatactaagttcggtctttagtgctatagctaggagtacacagctttaaaatataaacanagtgaagatatactaactcgataatggcaa

SEQ ID NO: 52525 - DNA, 101 bp, rice(Oryza sativa)
  misc_feature (71): n=t or c
ttttttcaccatatataacttaatgtttcacttattggtcaacgctcgcccccgcactgccgctcgcccangttgctcccgtgccgcgttgcttgcctgca

SEQ ID NO: 52526 - DNA, 101 bp, rice(Oryza sativa)
  misc_feature (71): n=a or g
gcgtaccacgcgcacacagatcgtagccactccaatacagtactgttccgtgcaacatgatgcctcccccngtaaactaataacgtcattgttaatcaagc

SEQ ID NO: 52527 - DNA, 101 bp, rice(Oryza sativa)
  misc_feature (71): n=t or g
gggtatgtctgactaagttgcttatctctgaactagtgaaggaggaaggacgagtattgtggatttccttngggttgggaatgggttgaatccatttttct

SEQ ID NO: 52528 - DNA, 101 bp, rice(Oryza sativa)
  misc_feature (71): n=t or c
actattcacttttctcaccaacctccactactcatccaataatagccctctactacttacttctacctacntttttaataaccatgtccaactctaaaact

SEQ ID NO: 52529 - DNA, 101 bp, rice(Oryza sativa)
  misc_feature (71): n=t or c
caccggtgaaaagggcccaaacggcccctcaccgtcaccgagggtccgagacaccgaggtcccaatcgttnggcttatttcctaataagccaaaacgactt

SEQ ID NO: 52530 - DNA, 101 bp, rice(Oryza sativa)
  misc_feature (71): n=t or c
aaagagagagaaaaagggagagggggaggaggaagaagggatttatgtcggctccacatgtcagtagggcntacaactttttttaatgacaaatgggcccc

SEQ ID NO: 52531 - DNA, 101 bp, rice(Oryza sativa)
  misc_feature (71): n=a or t
aacctacagaattagtgaaggatgggaatgaaaatcatggtaatagccttagactgaaagtctgggacacnaatctgtcactgtggagagcgattaaacat

SEQ ID NO: 52532 - DNA, 101 bp, rice(Oryza sativa)
  misc_feature (71): n=t or c
gacatagtactagtagtgtttatttccatctcctgtaggagtaaaataaacaaacttttaaaagatactantcacaatattagagtaagttcaatagtata

SEQ ID NO: 52533 - DNA, 101 bp, rice(Oryza sativa)
  misc_feature (71): n=t or g
gagacgagcgggtggacgatgtccggagtgacctaggggagcaaatgggaggatttagagggagagaggangtccatggcgagcggcaatgccggccgaag

SEQ ID NO: 52534 - DNA, 101 bp, rice(Oryza sativa)
  misc_feature (71): n=t or g
cggctggcagcgccctcccctctgccggagggtaggcgggaggcggcagcggtagcattttgtcttttttntgtttttagaatttgtgatacattggatct

SEQ ID NO: 52535 - DNA, 101 bp, rice(Oryza sativa)
  misc_feature (71): n=t or c
aatgtgagtcttgtagccccacactattttttttccagagatggtggtgggagtggtggcagatttcaccngacaccaccaccactattatattttaaaat

SEQ ID NO: 52536 - DNA, 101 bp, rice(Oryza sativa)
  misc_feature (71): n=a or g
gaacagcaaacttttttcttggttgctgctgggcttagggcctgtttaattcacgaaaaaaaacttttagngtgtcacatcagatgtttgaccggatatcg

SEQ ID NO: 52537 - DNA, 101 bp, rice(Oryza sativa)
  misc_feature (71): n=c or g
tttgctcgaggcttgctaagattgacgatcatgaatcatgacttttgtatttgaacggattttgaccggantttgctttctactgttgcccacaaccaggg

SEQ ID NO: 52538 - DNA, 101 bp, rice(Oryza sativa)
  misc_feature (71): n=a or t
atgttcaatgttcctaccatttctgccattctattgaaattcccaacgacccccaagtctatggattgctntagagaaaactgaaaacagagtgtattagt

SEQ ID NO: 52539 - DNA, 101 bp, rice(Oryza sativa)
  misc_feature (71): n=a or g
tacacaaccaaaccctagctgacaccttactagttaaatcccagccgtcatccaaattccacacccaccantatcacctatccaccatactctcagccacc

SEQ ID NO: 52540 - DNA, 101 bp, rice(Oryza sativa)
  misc_feature (71): n=c or g
ctttttttttttctcatactccccttccgaagaactcctcggagaagtcgaaccaatctcgccgctttctntctcctctcccgaaccggcacgaacctgcc

SEQ ID NO: 52541 - DNA, 101 bp, rice(Oryza sativa)
  misc_feature (71): n=c or g
caacatcattatattataaaaaaaaccctaaaagctgtaaaatacagctcataggagtaggcacgtaacanacgtaacagaccttgtgaattacaggggat

SEQ ID NO: 52542 - DNA, 101 bp, rice(Oryza sativa)
  misc_feature (71): n=c or g
aaaaatgattatcttgttctagaatattagagggttaggtagtgtagctagaggtggacaactgaaagagntgatcaaagaaaagagggtgtacattatct

SEQ ID NO: 52543 - DNA, 101 bp, rice(Oryza sativa)
  misc_feature (71): n=c or g
gcaggcaggtctcggcctctcgggtacagctatagctgctggtggtggtgaacctcctttctttcgtgagnccatgggcgcgctgcagcgttgcaggggcc

SEQ ID NO: 52544 - DNA, 101 bp, rice(Oryza sativa)
  misc_feature (71): n=a or t
ccttttgtccccagctggaggtgcttgctcacaaggccacaggtatgggaaccaacaaaaactcaaattanttattttgacaacaaaataattttcttcca

SEQ ID NO: 52545 - DNA, 101 bp, rice(Oryza sativa)
  misc_feature (71): n=a or t
ggacttttggttgggagcagaacgtcctccttcgtgggacggatggagtattctcttgcacgagtatcacnggtattataggtcctaagtatcacaggtac

SEQ ID NO: 52546 - DNA, 101 bp, rice(Oryza sativa)
  misc_feature (71): n=a or t
ttggtggaataatctctcctagcaattcaatatcctccacaaacctcacagcatctttggcccactcaagnttcaactcttctattctttgcttttccaaa

SEQ ID NO: 52547 - DNA, 101 bp, rice(Oryza sativa)
  misc_feature (71): n=a or t
tagcaaaggttggtgctcagtagcctaggctgaatggatgcatatgttattatgttaaatacagcagggcngaatttgtgaactcttcaatgtttttttaa

SEQ ID NO: 52548 - DNA, 101 bp, rice(Oryza sativa)
  misc_feature (71): n=a or t
agttgtcgtgtgcgacatgtgagtttgcgaccgaggtgaaaaagggacgtagttatctgttgtgtcttaanaaggaactaaggaagggcccctcctaacat

SEQ ID NO: 52549 - DNA, 101 bp, rice(Oryza sativa)
  misc_feature (71): n=a or t
ggaagaagtatggcaagagctaggactagcttagacatggtcaacacagcctactctatctattactcccnccgtttcaaaatatttgacaccgttgactt

SEQ ID NO: 52550 - DNA, 101 bp, rice(Oryza sativa)
  misc_feature (71): n=a or t
agctaaatggagaaaactgaaaagcgattatgcttgtcttcagttatagttggctgacctggctcagctcnagcacttgagtagtgtcacgcagagaaaca

SEQ ID NO: 52551 - DNA, 101 bp, rice(Oryza sativa)
  misc_feature (71): n=a or t
tgaattcagaatcagcgttaccatcaacaagcagtgagatgcacacaaagcactgttagatgttttttttnaaaaaaaaagaagacctgtttggtgttagt

SEQ ID NO: 52552 - DNA, 101 bp, rice(Oryza sativa)
  misc_feature (71): n=a or t
gttactgggtaagtacgtgtacgtagttgccacgtttcaggcttttgatgctggccgattctggcatcgcncaaagcttttgcttttgcaggaaatggatg

SEQ ID NO: 52553 - DNA, 101 bp, rice(Oryza sativa)
  misc_feature (71): n=c or g
atcggagaaggaaaggggtggcccgatttggaaggggtatcggcggctgcgtgacatggttggttgaaganaaccctgacaggtggaagaggagggagggc

SEQ ID NO: 52554 - DNA, 101 bp, rice(Oryza sativa)
  misc_feature (71): n=a or t
catgttgcatcaatggagatacggacaaacacggtaatgaacgatttcagaaaattgctcagatttttttnaaaaaataaaataactagttggattacttg

SEQ ID NO: 52555 - DNA, 101 bp, rice(Oryza sativa)
  misc_feature (71): n=a or t
catatatattttttatataaaatttagttcctcaaatactaggatacgagaaggatgtcattgtttttttnaaaaaaaatgttacctcctaaaatatttct

SEQ ID NO: 52556 - DNA, 101 bp, rice(Oryza sativa)
  misc_feature (71): n=c or g
tactgttcaaaatttgttccaaatttcatcgatcatttcttaccttcttacctaacatcggccacaaagcnagatgtttttaatccctttattgtccttta

SEQ ID NO: 52557 - DNA, 101 bp, rice(Oryza sativa)
  misc_feature (71): n=a or t
gtttgggcttatccgcataatatataatcagggccagatatgcatctaggctggacgtactattttttttnaaaaaaaaggaaattgaaactggacttgtc

SEQ ID NO: 52558 - DNA, 101 bp, rice(Oryza sativa)
  misc_feature (71): n=a or t
cagtagttagtagttagtagttggaaacacgcacaattaatccgcgcagaaagtgaacaccaaatttgtcnttaactcatgaataaaaaatatatatatat

SEQ ID NO: 52559 - DNA, 101 bp, rice(Oryza sativa)
  misc_feature (71): n=a or t
attatagagccctcaacaacattacagccaagaacaagtatcccatgccagtggtggatgaattgctagangaattggcaggatcgcaatggtttactaag

SEQ ID NO: 52560 - DNA, 101 bp, rice(Oryza sativa)
  misc_feature (71): n=c or g
tataaaaaaaatattatgagagctggtatataagctatccatggactcagccggtttgataaatgataatnaacattttcttcaacatgatatttttaaag

SEQ ID NO: 52561 - DNA, 101 bp, rice(Oryza sativa)
  misc_feature (71): n=c or g
ttaatagcaccacgcagtgatttagaagcgttgataggatttttaaagtgacggagggagagatgctaganctagtagttggtctatttgtgattttcttt

SEQ ID NO: 52562 - DNA, 101 bp, rice(Oryza sativa)
  misc_feature (71): n=a or t
aagagggaggtagggttgggggagggggagtggtttggagacagcctgttcattcaaaaattgactgatanttttttctattttcagacctcggaactata

SEQ ID NO: 52563 - DNA, 101 bp, rice(Oryza sativa)
  misc_feature (71): n=a or t
tgacgatctttctgtcgtcatagagtctatggcatccattttcgtcgccatcaagcccagaattcgtcatnagatgccatttggccttttaaggcccatgt

SEQ ID NO: 52564 - DNA, 101 bp, rice(Oryza sativa)
  misc_feature (71): n=a or t
gtataaaacatgtgaataaaaacacacagaaaacaaaacttaggaaatcgtttgcattgaaaaacagagcnaattaatgtatatgaacaaaattaatatcc

SEQ ID NO: 52565 - DNA, 101 bp, rice(Oryza sativa)
  misc_feature (71): n=a or t
atatggtagagaaattaggaagaaaaaaaaaggaaattggtaaaaccgtaaaaggcccactaagccaggcngccagcccaccaaagaccaacattagtctt

SEQ ID NO: 52566 - DNA, 101 bp, rice(Oryza sativa)
  misc_feature (71): n=c or g
ccatcggtcaaacttgctctctggtaaggaaaggagcgatgctctgatttggggtgagtgaacgaagcaancggtcgaggtccttggccttcatgttggtg

SEQ ID NO: 52567 - DNA, 101 bp, rice(Oryza sativa)
  misc_feature (71): n=a or t
tgtagtcaatgtcgccgttagctcttcggatgggatgtgttccccttttatatgtcgcaggatataaaaantttttataaaatagatcgtgacgagagcac

SEQ ID NO: 52568 - DNA, 101 bp, rice(Oryza sativa)
  misc_feature (71): n=c or g
ctgcctgattacttcctggcccatgccattaggtgagcctcactttcttctctgcaaacaaacactacaanaagaggtttagctctctgccaaaccaccac

SEQ ID NO: 52569 - DNA, 101 bp, rice(Oryza sativa)
  misc_feature (71): n=a or t
ttgtgtcattcactaaaaagaggattccagtacctcctctttatcaccgcatcagagaacaagatacgctngagattgctaaatcacaggccacattatga

SEQ ID NO: 52570 - DNA, 101 bp, rice(Oryza sativa)
  misc_feature (71): n=a or t
acacactagctagcagcagctgcactaattgacatatgcatgcagcagcttcagttcgagtagttctctcnggtttgccgcagctgaatattgctagcaat

SEQ ID NO: 52571 - DNA, 101 bp, rice(Oryza sativa)
  misc_feature (71): n=c or g
tatacacaaccaacaagctttgaaatctacattatgatgagtttgaattccttcggacgtgtcaattgganaaatacgcccatagtgactcggatggatat

SEQ ID NO: 52572 - DNA, 101 bp, rice(Oryza sativa)
  misc_feature (71): n=a or t
agttgtaggctaaaatgtttcatgaaaccaagattaatgaatgtatcgtatacctcgtataatattttttnaaaaaaacaaattaccattataaaagtact

SEQ ID NO: 52573 - DNA, 101 bp, rice(Oryza sativa)
  misc_feature (71): n=c or g
gctgtataatcatttaggttgtgttccttgaacacgcatcataatgactatttgagctcgaaaattttcanctagctcaaagtgctcaacttttagttcta

SEQ ID NO: 52574 - DNA, 101 bp, rice(Oryza sativa)
  misc_feature (71): n=a or t
caaattgctaagatgaagaagcagtgcattatcgcccctcaaggctacacaatcatgcacaataaaaaaanatattttcacgatgcattagtactacctac

SEQ ID NO: 52575 - DNA, 101 bp, rice(Oryza sativa)
  misc_feature (71): n=c or g
caacacccatgagattattataccttctataatattctcatcgtccaaaaagaaagatatttccaccactnaagttttgtcatggaaaaaacaatttcttt

SEQ ID NO: 52576 - DNA, 101 bp, rice(Oryza sativa)
  misc_feature (71): n=c or g
tcctcatcagagagatattgatcattatcagtgtgtatcacatggcatgtaacacactgatctccatcttnttcatcctcgctttccgagaattctgaagg

SEQ ID NO: 52577 - DNA, 101 bp, rice(Oryza sativa)
  misc_feature (71): n=a or t
gagcgccactacctcctcgaccactaatgcgtcgccttttataattgttcgcgccaacgagactgctctanctggcttcctcctcctccccttccccacct

SEQ ID NO: 52578 - DNA, 101 bp, rice(Oryza sativa)
  misc_feature (71): n=a or t
gtcctccacttcttcccgtcttcctgtatgaacttgtgatgccacggaccagatgtgaacccttccaggancagcaacctaacttcaatagttcaattaaa

SEQ ID NO: 52579 - DNA, 101 bp, rice(Oryza sativa)
  misc_feature (71): n=c or g
attggtttttttatagatctatttatctctttttttttggaagtaaaactcgagaggaaggacatggtttntattgagatgaatagatctatgtattgtta

SEQ ID NO: 52580 - DNA, 101 bp, rice(Oryza sativa)
  misc_feature (71): n=c or g
caatggcgatatgtcgtgctatgtccttggcaaaggaagagggctttgagaaaattattttggcttcagantgcctttcagtcattctgagaatcaagctc

SEQ ID NO: 52581 - DNA, 101 bp, rice(Oryza sativa)
  misc_feature (71): n=a or t
actctctatatctggttgtgcgattagtggatgccaatcagactcgacttataatcaagggagaaaaaaanagactttcccttctacattattgtattgta

SEQ ID NO: 52582 - DNA, 101 bp, rice(Oryza sativa)
  misc_feature (71): n=a or t
gcggcggcggtagtggagagcgtgagagggcggggcgagccaacattgaaggtgtataagtgaggagaagngggcgaggagagctagagagaggagaggaa

SEQ ID NO: 52583 - DNA, 101 bp, rice(Oryza sativa)
  misc_feature (71): n=a or t
gggaacagggaaagcaaagcaggtgatcatacagacaaaatacccaagcttaagctagccttagtcaaccnaaaactaaaagggaagtatcgagtcggtga

SEQ ID NO: 52584 - DNA, 101 bp, rice(Oryza sativa)
  misc_feature (71): n=a or t
ccatcaaaaaaaaacaccgattcctactccagcgcaaatcacgcaaaaaaaaaaatcccataccgattccnactccagtctaacagattaagcccacaagc

SEQ ID NO: 52585 - DNA, 101 bp, rice(Oryza sativa)
  misc_feature (71): n=c or g
acatgcaggccatgatgaatatccaaagagaataacgcagaaaatctcgatctagtataattgtctactcnacgtccctctcttgtataatgtatccgtcc

SEQ ID NO: 52586 - DNA, 101 bp, rice(Oryza sativa)
  misc_feature (71): n=a or t
tgcagagattgcaattaagagatcgctccagttaaaccccaacaaccctacaatggagctggagaaggtanaactatctattctgctccacacataatttc

SEQ ID NO: 52587 - DNA, 101 bp, rice(Oryza sativa)
  misc_feature (71): n=t or c
caccctatccttaactcctgtcagggtaacccttttatcctggagattgaacctacgcttctttctcttcnagtctatccacataggactgaattgctcta

SEQ ID NO: 52588 - DNA, 101 bp, rice(Oryza sativa)
  misc_feature (71): n=a or c
accccggtggtagtgatctggatccgccctgcagaccccgtttacctgtgacaaattaactttcattgttnaaactctctggacataagactccaaaatag

SEQ ID NO: 52589 - DNA, 101 bp, rice(Oryza sativa)
  misc_feature (71): n=a or g
tatacaacgaatagagttctgagcatgcgggcttacatattggctttgttgcgttgcagacttgcagttgncctccactctgcacatctgcaagggaagaa

SEQ ID NO: 52590 - DNA, 101 bp, rice(Oryza sativa)
  misc_feature (71): n=t or c
tgtgttagttaaaacttatttcttgtactcaaccaccattaacttctcacgttcagggaaaacacaaaatnatagtagcttcctgtgttctaaaatttcag

SEQ ID NO: 52591 - DNA, 101 bp, rice(Oryza sativa)
  misc_feature (71): n=t or c
tagcaaattttgacttttgtttatacagagattgatgaaaactcgagcttctacgtcggtggcgtcaacgngcatctttcaccgaacagtcttcattttgc

SEQ ID NO: 52592 - DNA, 101 bp, rice(Oryza sativa)
  misc_feature (71): n=a or g
attagagctctgctccatttagagttcccaagtgctaagctgtcttttgcgggtcgttcttgtaatagttntgctcatgacattgctcgtcggcggcggca

SEQ ID NO: 52593 - DNA, 101 bp, rice(Oryza sativa)
  misc_feature (71): n=a or g
gcaactacaatccgaaaaaggaactggcacaatgaccaggccaaatcttgtgtttccagtcatagcaacancatggtgccttctgttactccaagcaggct

SEQ ID NO: 52594 - DNA, 101 bp, rice(Oryza sativa)
  misc_feature (71): n=a or g
ggccaacattctcccctccatgttgctcctccccttctatggtcgatctgcttccatattgggtcattggnagctccgtggcaagggtagatgtggtgcct

SEQ ID NO: 52595 - DNA, 101 bp, rice(Oryza sativa)
  misc_feature (71): n=a or c
aaagttcatatcgacaaatgttgcaatgttcagaccatccttgaacatatcgtgtgttggtctctttcgtnaaaatatttcgaagagaactattccaaagc

SEQ ID NO: 52596 - DNA, 101 bp, rice(Oryza sativa)
  misc_feature (71): n=t or c
attaaacttttcttgaaacatggatgacactagctaataggtacagacgtcgttgatgaagtaaaggtggnccacatcagttttactgtcgtagtagtacc

SEQ ID NO: 52597 - DNA, 101 bp, rice(Oryza sativa)
  misc_feature (71): n=a or c
ccgagcgcatgccacacgatgctgtattgcctgtcgaagaaggacatggccaaagaggcagttgagtttgngaagaggatgagtgctaggggttatctcct

SEQ ID NO: 52598 - DNA, 101 bp, rice(Oryza sativa)
  misc_feature (71): n=t or c
caatcatactgcagcaatgctccgagaacatgggttttaccccacattgcggcatgatgcattggagtatncatttcatcgtcgaattctctagccagccc

SEQ ID NO: 52599 - DNA, 101 bp, rice(Oryza sativa)
  misc_feature (71): n=t or g
gcaaataaccttccaaattgttctgcttcttggcaaccacagcgacagcggcagaaaacaattgatcgaantccaggtaattgcgcgctttaaatttttct

SEQ ID NO: 52600 - DNA, 101 bp, rice(Oryza sativa)
  misc_feature (71): n=a or g
cttgtttctcaccttctctcctctctctccctcaactttcctcccaagcgccggcgaggggcgactggcangcggcaatgatgaccttgggcgccttcggc

SEQ ID NO: 52601 - DNA, 101 bp, rice(Oryza sativa)
  misc_feature (71): n=t or g
aatgggcaatgaagggttattccctgcaggcttttgctcaactatgcaatcatctagatggcttaacaagncatctatggacaaggatctagcttgactca

SEQ ID NO: 52602 - DNA, 101 bp, rice(Oryza sativa)
  misc_feature (71): n=t or c
tcttgattggaggcagtgtttgaatgcaagggtcaggttgcgctggtaggtatctgaggaattcaggaatngaggatgatgagtaatggccacagcaacag

SEQ ID NO: 52603 - DNA, 101 bp, rice(Oryza sativa)
  misc_feature (71): n=t or c
gcctcctggattcttggtagcatcttcatgttctggttgcttctcgatatccacttttgcatttggagtantatcctcaaaattgctgaagtttcccttaa

SEQ ID NO: 52604 - DNA, 101 bp, rice(Oryza sativa)
  misc_feature (71): n=a or g
ttgtttagacaaaagattgttatgtcatgttttagggcataagagcaagctctgggtaattcccattgtcntaattcctgtggtggcatttttctgcttca

SEQ ID NO: 52605 - DNA, 101 bp, rice(Oryza sativa)
  misc_feature (71): n=a or c
cgaggataactccttttttgtctgtaattctaagttctccatctccctcaagccaatcatacattccagancaccaatatgcagatcgataaattgagaac

SEQ ID NO: 52606 - DNA, 101 bp, rice(Oryza sativa)
  misc_feature (71): n=t or c
gaagagtaagggcccgatgcatcccatctccaacaaaaatgagtcttgttcagcatggttcctaacccctnctccccgacacacaaaacgaagtctctatt

SEQ ID NO: 52607 - DNA, 101 bp, rice(Oryza sativa)
  misc_feature (71): n=a or g
tcaagcgcttagtttaggattgggattggttaggttttattaggattataaccactcatcccttacatcancctgatgattataaacaagaagccaccaaa

SEQ ID NO: 52608 - DNA, 101 bp, rice(Oryza sativa)
  misc_feature (71): n=t or g
gctactgtcaaatcagttccctggtacagctcttcaagggtgcacataagttctccaactgttgcttgtgnattatccaattgatcatgataaatcattgc

SEQ ID NO: 52609 - DNA, 101 bp, rice(Oryza sativa)
  misc_feature (71): n=a or c
ttgttcatagctcgagcaaacttgaaagtaaccaaaaccaagtactcctccttgaattgttcgagttgctnatcggacatggcattaattaaagcaagaat

SEQ ID NO: 52610 - DNA, 101 bp, rice(Oryza sativa)
  misc_feature (71): n=t or c
tgcctcagcgagaaggcctggctgaagagcttgatctcctgcttgagctcatccatcctgctcttctccangtccagctccctgagcgcctccagcctgtc

SEQ ID NO: 52611 - DNA, 101 bp, rice(Oryza sativa)
  misc_feature (71): n=a or g
tgggagaacatggcaaacatgtgcggtgttccgaagaagggactcagatccctcatcctgttagttgtctnggagatttggaaagagaggaatcggaggat

SEQ ID NO: 52612 - DNA, 101 bp, rice(Oryza sativa)
  misc_feature (71): n=a or g
ggacatgttcaacagagattttcccaagtatgaaattagggattttttaccttgatttcaatctcctccancggcgcctaacaggctcaccgagacaacga

SEQ ID NO: 52613 - DNA, 101 bp, rice(Oryza sativa)
  misc_feature (71): n=a or g
tgctgaacttcttgttgcatgcagatggagccttatataattgcgatatcaaaccaagaaggtaaagagangatggtcgttggtggggcggatccaaatgt

SEQ ID NO: 52614 - DNA, 101 bp, rice(Oryza sativa)
  misc_feature (71): n=t or g
ttgccaggttttgtatggcccagctccttggaatcaatcaccacctcactaattttcttttcaagtgccantaaaagggctggggaaaaagttcgattatt

SEQ ID NO: 52615 - DNA, 101 bp, rice(Oryza sativa)
  misc_feature (71): n=t or c
gaacagatctaaaggaatgtcctatggaattaaatgtcgagtataaacagaagcatgcagtctgtcccaanagagatcaaagaaggagctgatgaggaaat

SEQ ID NO: 52616 - DNA, 101 bp, rice(Oryza sativa)
  misc_feature (71): n=a or g
taatcctagttatgttgggtatggtcttatttccccccatattgtcaactgctcagtttttcttgggtcantcatatcttggggttttctttggccattta

SEQ ID NO: 52617 - DNA, 101 bp, rice(Oryza sativa)
  misc_feature (71): n=a or g
tctacaggtactggtttcatatcatacagctgcttgcaacacttgctcttgctcgttgttgggtctcccanaagctcttctcagaaacctttcgacaacag

SEQ ID NO: 52618 - DNA, 101 bp, rice(Oryza sativa)
  misc_feature (71): n=a or g
tcaacagcaggcttagggaatgcctcactaatcttcacttctccatctttacgcttcccttgtatattggnagggtgataggccacatcagcaataggagt

SEQ ID NO: 52619 - DNA, 101 bp, rice(Oryza sativa)
  misc_feature (71): n=t or g
cccttcttccttcttttttcctcccttccctttcttcacttcttgcaggcaagggcatgagcggcggcggncggcgaggcgcaatggcgatggcgcgggta

SEQ ID NO: 52620 - DNA, 101 bp, rice(Oryza sativa)
  misc_feature (71): n=a or g
agggagccctcgttttcagagtaagggggtttccctgagatgatttcaagaagcagtatgccaaaactgtnaacgttccctgccagtctagcagatattgg

SEQ ID NO: 52621 - DNA, 101 bp, rice(Oryza sativa)
  misc_feature (71): n=a or g
acggactcatcagagtcactcctctctgcctcagcttcttcgccatttgcagcaggttgtttgacattagntttggttgctggagctggtcccgctttctt

SEQ ID NO: 52622 - DNA, 101 bp, rice(Oryza sativa)
  misc_feature (71): n=t or c
tatgtggataatgacatcatttgcagttgtgcctattctctctgggacaatgttttgttttcaaacacagnatctgaagcttgatccatcagtcatcggcc

SEQ ID NO: 52623 - DNA, 101 bp, rice(Oryza sativa)
  misc_feature (71): n=a or g
ccgcaaagttgtatcatgggcgttctatcagatctccacggaggccaagagaatatccctttcacttcccncgacgtcgagaacaggtgattctttcaagt

SEQ ID NO: 52624 - DNA, 101 bp, rice(Oryza sativa)
  misc_feature (71): n=a or g
tcaaaacagctcggaatcctcgcgtccaccacgttaacaagtgcacccttgctccactgctcagtcacccngtccacaagcacggcacggttgccgtgctc

SEQ ID NO: 52625 - DNA, 101 bp, rice(Oryza sativa)
  misc_feature (71): n=a or g
cgatcgtgcaaatgaagcaccaatgcataagtttgacagggtgggaatatcaacaaggatgaagcatatcncggaacaactacaacccatatgtgctaagg

SEQ ID NO: 52626 - DNA, 101 bp, rice(Oryza sativa)
  misc_feature (71): n=a or g
cctttgcgtcgatgcttgcttggtagcaaccttccctatgatgcagtcatcaagaaccttcgttgctgtcntccttatctgcatcgggcgagccaacgacc

SEQ ID NO: 52627 - DNA, 101 bp, rice(Oryza sativa)
  misc_feature (71): n=a or g
aagatgtgggagtatcttcaacaacgctatcaacagagcagtgcagctctccgcttttctcttcgcaagancttgcaaagccttgaacagggcgacatgac

SEQ ID NO: 52628 - DNA, 101 bp, rice(Oryza sativa)
  misc_feature (71): n=t or c
cagcataactcttctgccgagacagggcgattctcaatctgatgtttgccagagagtgaaagtagaacagnagaggcccgtaggactactactacctcttc

SEQ ID NO: 52629 - DNA, 101 bp, rice(Oryza sativa)
  misc_feature (71): n=a or g
cgcgcaggccaccaccttcaccagcaacgtcgacggcaaggagttcaccacattctccttccccaagttcnacaagcccctgttgcagctccccgacaacc

SEQ ID NO: 52630 - DNA, 101 bp, rice(Oryza sativa)
  misc_feature (71): n=a or g
cccatcttcaagatgtggtacattttcggttaaccgcgtaacgactccactctgaatctcatcattctcanttccactggccttagagtcgtttccggaag

SEQ ID NO: 52631 - DNA, 101 bp, rice(Oryza sativa)
  misc_feature (71): n=a or g
tgctctatcagctgtggtacccctttggttaaatgaggtgcaggaaggatacaagactgaacctgctactnagcaattgctgacacaagtgttgttgtctc

SEQ ID NO: 52632 - DNA, 101 bp, rice(Oryza sativa)
  misc_feature (71): n=a or g
aggagggcatgtggctgcaggaagagaatgatgtgctgcatgctgagaacaaagtgttgaaggaggcgatntgggcaaatatctgcttcacatgcggcagc

SEQ ID NO: 52633 - DNA, 101 bp, rice(Oryza sativa)
  misc_feature (71): n=t or g
cccgcaccaacaccgggatgtcatgtcactggcaacgccccggaatagccgcggggagagcggagaaaaanaaaggggagcggaaagccgcgtgccgcgtg

SEQ ID NO: 52634 - DNA, 101 bp, rice(Oryza sativa)
  misc_feature (71): n=t or c
ttatgagtgtttataccctgtgtttactgtactgatagtgatactcaaggcagtcctgccgttggcatgtntggaagcttaccagcggagaggcatcggtc

SEQ ID NO: 52635 - DNA, 101 bp, rice(Oryza sativa)
  misc_feature (71): n=a or g
tccgattccccgaactaatgttgtggggagggtgcaggagactagaatgctggttgataagcttacagggnaaggcatctcaggcccagggatgactggac

SEQ ID NO: 52636 - DNA, 101 bp, rice(Oryza sativa)
  misc_feature (71): n=t or g
acggagggaaaatagtgccaagttaactgcagaagagtgcagggaagcatacccgtatctcaagttctctnaacttagaggcattccgaaatattgaacaa

SEQ ID NO: 52637 - DNA, 101 bp, rice(Oryza sativa)
  misc_feature (71): n=t or c
ggggttaaatatacatggagtggagtctcaggaggatgtgggaatgaatcattatggaatagaaacaaacnagccatggaggtatccgcagatgcagccaa

SEQ ID NO: 52638 - DNA, 101 bp, rice(Oryza sativa)
  misc_feature (71): n=a or g
aattttcccctgttgtcaatctgaagcttggattcatgctgattgctctcatctggaagttcgatttctcnccgttcatgatcctcgtcatcgcgatcctc

SEQ ID NO: 52639 - DNA, 101 bp, rice(Oryza sativa)
  misc_feature (71): n=a or c
atgttagaaaggaggatcataaggtggttgtggtcctcgcacaaagaagcggcactaatcagacaagactntggagatttcttatgtgagcatgaatcctg

SEQ ID NO: 52640 - DNA, 101 bp, rice(Oryza sativa)
  misc_feature (71): n=t or c
tgaccccgaaaccatgaaggagtacatctacctcgtcgatggcaaagaggtggagaaggtggagttcgggnagcaagtcaaacaggtagcctacggggttc

SEQ ID NO: 52641 - DNA, 101 bp, rice(Oryza sativa)
  misc_feature (71): n=t or c
gatttgtagctcttccctttttttggaatgcgattcaggacctaaccatttgaagccacttgaatcatttncagcagccgatgatgaagagtcctgaatga

SEQ ID NO: 52642 - DNA, 101 bp, rice(Oryza sativa)
  misc_feature (71): n=a or c
catggccttcatctccttcaagtatcgtgccatatcagggacgatctccttatcaacgacgtccttgctgngatgtcgaccgtaccctctctgcgcccaca

SEQ ID NO: 52643 - DNA, 101 bp, rice(Oryza sativa)
  misc_feature (71): n=a or g
attccagctgaggtaatgcgtccaaaaaccaggttacagagtggcattaggaaagaaaaagtttatactgntggaactgttagatatagttgtttcacatc

SEQ ID NO: 52644 - DNA, 101 bp, rice(Oryza sativa)
  misc_feature (71): n=a or c
attcatccattgagatgaaggtaagcgcccgttgcagagattttttctggtttggcagtgaatttgaatcnaccgtgcttaattgtttttcttttttgggc

SEQ ID NO: 52645 - DNA, 101 bp, rice(Oryza sativa)
  misc_feature (71): n=a or g
acattcatcacaccgttcggtgtattctgttacgtcaaaataccatttggactccagcatacggtccaagnggcacttagcgatcagctgggtaacaatgt

SEQ ID NO: 52646 - DNA, 101 bp, rice(Oryza sativa)
  misc_feature (71): n=a or c
ccgtggatctagcagcaaagatccaagcactcacgttagagtgccgtgaaaaacaccgataaatccatgcnaaactccctaattcattgcacattcgagtg

SEQ ID NO: 52647 - DNA, 101 bp, rice(Oryza sativa)
  misc_feature (71): n=a or g
atgagaaataaattggtaataataatttattagctctttgagtggggttagatctgtgcaaccgggcttgnttgttcaaaatggttggaactgtgcaacat

SEQ ID NO: 52648 - DNA, 101 bp, rice(Oryza sativa)
  misc_feature (71): n=t or c
aaacctaaccctaaccctaaaccacacccctaaccggcctaaccggtgcttgtcgtcacgccctagggacnatgcgcatgacctagcgttgatgcaccgat

SEQ ID NO: 52649 - DNA, 101 bp, rice(Oryza sativa)
  misc_feature (71): n=a or g
ttcaggttgtaaacattcttacagccatatagtgcacttcgctaatattccaaccgccagtatatttcctnaatccattcaaggggtcttttctatatgtt

SEQ ID NO: 52650 - DNA, 101 bp, rice(Oryza sativa)
  misc_feature (71): n=a or g
aggtgacaccctagattcgaggacctacatattatagggtttaggcgtttgggatcaaagttggagtaganaggagttgggagagagggtaggagtttctc

SEQ ID NO: 52651 - DNA, 101 bp, rice(Oryza sativa)
  misc_feature (71): n=t or c
gtgtaggtctatgttattggaggagttggtgataagcaatactacagtgatgcctggattcttgatgttgnaaatcggtcgtggacacagcttgagatatg

SEQ ID NO: 52652 - DNA, 101 bp, rice(Oryza sativa)
  misc_feature (71): n=t or c
tctgccattggcaattattactatggctagcctattggctgataaatcagatagaagagaagaatgggttngcattcggaattcaattggttcaggactcg

SEQ ID NO: 52653 - DNA, 101 bp, rice(Oryza sativa)
  misc_feature (71): n=a or g
gctcggttgctaaggttcagaaagttgttgtgatgtcctccaatgctgctgttgatgttaacccggactgnccgccaaatagactcaaatatgagagttgc

SEQ ID NO: 52654 - DNA, 101 bp, rice(Oryza sativa)
  misc_feature (71): n=t or c
atttgctactgtgattcttttcttatatttatcacgcaaatgatttcaggacctgtcgacagggtggcttngttgtgaccctggtcctatgtttaagccag

SEQ ID NO: 52655 - DNA, 101 bp, rice(Oryza sativa)
  misc_feature (71): n=t or c
agtcaacccgccatgtaggtgccatgtatgatgaaactacctccgaaaccatccaggggtcgatttacaanggttttggaagttaggggacgggttatacc

SEQ ID NO: 52656 - DNA, 101 bp, rice(Oryza sativa)
  misc_feature (71): n=a or g
gcactaactaacaacactctcgttatcaggcataagaaaaactttcctacaacaccaatgcaacactagcnttgaagaaaatagatgcatcctaaattcct

SEQ ID NO: 52657 - DNA, 101 bp, rice(Oryza sativa)
  misc_feature (71): n=t or c
aacttctgttttctcagacgtgttatcagctggagttgtatgttcagtttccaacttcactctatcatggntccacacgtcttcatcatcccacttcacat

SEQ ID NO: 52658 - DNA, 101 bp, rice(Oryza sativa)
  misc_feature (71): n=a or g
accattgctgttgaagaggtggcgaggagcgatggcggcggcttctagagcgatctcgacgataatgggancagacaacgacgtgggaatgggagctaggg

SEQ ID NO: 52659 - DNA, 101 bp, rice(Oryza sativa)
  misc_feature (71): n=t or c
gcaataggccctctggagtctggacgcaaacgtgcaaactgttgctagttccatttggatttacaaaacanggtttcattcttgcatgaaaatactacctc

SEQ ID NO: 52660 - DNA, 101 bp, rice(Oryza sativa)
  misc_feature (71): n=t or c
accactatctacaagcatcgactagaaaacatccagagtcatgcacggcgatcaaatgattctgatgtatnaacaccatgcctgctgacagaaagattgcc

SEQ ID NO: 52661 - DNA, 101 bp, rice(Oryza sativa)
  misc_feature (71): n=t or c
ttcatctctgacagtgacaagtatgctccagcaaattttcggggcgaacaaattgactattgttttgaatngttattacagaactatcacaagtttcaaat

SEQ ID NO: 52662 - DNA, 101 bp, rice(Oryza sativa)
  misc_feature (71): n=t or c
gattgtggtcggggtaggaaaaagtttgaaggaatggccgtcgaggatggtacttatagtggacgattgcnggagaagtgggaacccgggtccccacctct

SEQ ID NO: 52663 - DNA, 101 bp, rice(Oryza sativa)
  misc_feature (71): n=t or c
ctcaattactcaaatagttaaacagcacgcgcgatgcggtcatgctagcaagcagtagaaaagagagaggntgcaattttgcatcaggtggtggagtgagc

SEQ ID NO: 52664 - DNA, 101 bp, rice(Oryza sativa)
  misc_feature (71): n=t or g
cttttttaaacaaacgcaagaagatgatcaaacacaccacacacatttctacatacatctcatcaccaaanatcttgagcggatgggtacgtatagaacac

SEQ ID NO: 52665 - DNA, 101 bp, rice(Oryza sativa)
  misc_feature (71): n=t or c
tcctgtacatgctcttcagctagttgttaccctgatcctgcatgagtgacatcaacctcatcttcgagtanatctcgaaagaagcaagagagaagtcggtg

SEQ ID NO: 52666 - DNA, 101 bp, rice(Oryza sativa)
  misc_feature (71): n=a or c
tgctgcattaagttttccttatcgtgtgtcctgtcacatctattgctttctgattgaagtctttgtgaagnatctggttaaacaatataaatatataatgt

SEQ ID NO: 52667 - DNA, 101 bp, rice(Oryza sativa)
  misc_feature (71): n=t or g
tcctgaaatattgtaacaggaaccatagagattagaagggagaacacctaatattctccctcatcttgtcntattaggatgaacatgttgatatgcattga

SEQ ID NO: 52668 - DNA, 101 bp, rice(Oryza sativa)
  misc_feature (71): n=a or g
gacaataatatggttaattatatgaaggcttctgttaattataaatggtagagctgaaaatgttgcaacgnttacacttgcgacttttgattttcttttct

SEQ ID NO: 52669 - DNA, 101 bp, rice(Oryza sativa)
  misc_feature (71): n=a or c
gtacctgttccagttggttcttccttcttgcgaaacagattgaaagctccaaccaaactagacactctatngaaggctgcctctgtcatggatctctcacg

SEQ ID NO: 52670 - DNA, 101 bp, rice(Oryza sativa)
  misc_feature (71): n=a or g
attttgccaacgatcaatttattgagacatgtgatgatgcgtagtaagcataatactaaccctgttcttgntagctgaaagttattatattttaaaatgga

SEQ ID NO: 52671 - DNA, 101 bp, rice(Oryza sativa)
  misc_feature (71): n=a or c
atgtgttgattaactatataatgggcagggtttgagcaagtgagctacctgtgttccatgcatgctgtttnttgtacaatgtcttgttgtcactacggaca

SEQ ID NO: 52672 - DNA, 101 bp, rice(Oryza sativa)
  misc_feature (71): n=t or c
acaaggcattatcataagatgtggtgcccgccatgtgcacaattcatatgattgatggatgttcgaataancaaaccttttctattagttaccactactat

SEQ ID NO: 52673 - DNA, 101 bp, rice(Oryza sativa)
  misc_feature (71): n=a or g
aatctccaatctcagcatgctatgggatagaatcaacataactattggggcgccacttgtttggagtattnttgaccaaacaagatgctcaagaaacatgg

SEQ ID NO: 52674 - DNA, 101 bp, rice(Oryza sativa)
  misc_feature (71): n=a or c
gttttatttccctttttcaccattgctttgtaatattcccaggctcccgagatttggagcatcatttctcngggtggttatatttatgtctgtggtgatgc

SEQ ID NO: 52675 - DNA, 101 bp, rice(Oryza sativa)
  misc_feature (71): n=t or c
agtgaccaagttaattgattggttttctggaaattcatacacaatcagcacctcaccatatttttctgttntctgatttctcaaaacaattccaggatttt

SEQ ID NO: 52676 - DNA, 101 bp, rice(Oryza sativa)
  misc_feature (71): n=t or c
ctcccgtcgcaccaaaccccgtagctgtcaccgtcggatttgccagtggagccaccgaatttgggaatcanagtcaccggcgaggaggtgttggcggcgag

SEQ ID NO: 52677 - DNA, 101 bp, rice(Oryza sativa)
  misc_feature (71): n=t or c
catggctgcaattatgtaaacatttgtaatggtaagttgcctgatgtctcatgaacttaattgagaaaaantttatcagcacatgctttatgactggtttc

SEQ ID NO: 52678 - DNA, 101 bp, rice(Oryza sativa)
  misc_feature (71): n=t or c
gtatattgcaaacaagctcgacgctgttaactgggacgctttcatagttggataattttagaacagatgcnatcaccgggaccaaagacaagtcgcaatct

SEQ ID NO: 52679 - DNA, 101 bp, rice(Oryza sativa)
  misc_feature (71): n=a or c
catgagacataccttgggcgtccgggaaagaaccactccgatgtggttttgcataggtacattttagtttntagtgcaaatttctatctattagaatataa

SEQ ID NO: 52680 - DNA, 101 bp, rice(Oryza sativa)
  misc_feature (71): n=a or g
tagaggggatggctgaccatttgtgagatttcttttccctatgctgatggtagaggagtgttggaaatgangactgcgaattccttcagaaaacatcaaga

SEQ ID NO: 52681 - DNA, 101 bp, rice(Oryza sativa)
  misc_feature (71): n=a or c
caaagagcttgagattgtcaacttcatcaagttcacccaatttcacacagtcagctttaactcctatgccntcttctgcaatgtccactactgattgcatt

SEQ ID NO: 52682 - DNA, 101 bp, rice(Oryza sativa)
  misc_feature (71): n=t or c
acaggcttctcgccggggctgcacaaggagctcatgacctcccgtggatcgccacatactggcagctcggnggggctgcacaaggagttcatgagctcccg

SEQ ID NO: 52683 - DNA, 101 bp, rice(Oryza sativa)
  misc_feature (71): n=t or g
atggcattctcaatcttcgctgtaacttttggtaccaatggtttgatctctttggtgaatgatctgttctnggtgaagagataaccgtagtcattgcctcc

SEQ ID NO: 52684 - DNA, 101 bp, rice(Oryza sativa)
  misc_feature (71): n=t or c
cctttcttcccggggcgccggaagaatttcccttgcaaatacctggccttccactacacattcggaaactnagaaaagttgacttacaacctttggtggac

SEQ ID NO: 52685 - DNA, 101 bp, rice(Oryza sativa)
  misc_feature (71): n=a or g
atagggtttgggccaagaaagaagctaggctgaggcccagtccattattatttcagaattcctaattcgcncatacgcgctgacttctggctcacggacca

SEQ ID NO: 52686 - DNA, 101 bp, rice(Oryza sativa)
  misc_feature (71): n=a or g
agcattggttgagctggtaacgccgtaagaaatactaaacttattatggatgaaaaaccaaggtagaaagnagcctaaaatcaaatctaaaattaagtttt

SEQ ID NO: 52687 - DNA, 101 bp, rice(Oryza sativa)
  misc_feature (71): n=a or g
tgggccaagcttgttagttaggaaggcatttgttacgatgggttgtggtccggcccgcaacaatattgtgncccgttgtgagaaattcatgccgctttgct

SEQ ID NO: 52688 - DNA, 101 bp, rice(Oryza sativa)
  misc_feature (71): n=t or c
agaaatactgctgatttttcaagctgcaatgatcttgcaactctggccctgaagatggtccaaactgaaangcatgtagcattcccactggtttatcgact

SEQ ID NO: 52689 - DNA, 101 bp, rice(Oryza sativa)
  misc_feature (71): n=t or c
tatagcaccattttccaccggccaacattgtaggttaaccatatgagaaaagacgatcttctttagagaanggaatgtatcagcattcagttcaccgtgta

SEQ ID NO: 52690 - DNA, 101 bp, rice(Oryza sativa)
  misc_feature (71): n=a or c
tgtgattttgccgtctctgtttttttaactaatgcttgagctttatccccattttgttgtctcctcttaanaatgtccaaaatcatataaaaacaggggca

SEQ ID NO: 52691 - DNA, 101 bp, rice(Oryza sativa)
  misc_feature (71): n=t or c
aaattttgactacaaaatcagaattcgtaagcatgtataactgccagaggaagcaggggaatcagtgtcantgcaccgtattccaaggaaataagtatcaa

SEQ ID NO: 52692 - DNA, 101 bp, rice(Oryza sativa)
  misc_feature (71): n=a or g
cactctacaccaacatgatgcatacttgtacatattcctacgtgatagaaatctagacgtactgtgtccantatcaaagcaagattatgcaagcctaggta

SEQ ID NO: 52693 - DNA, 101 bp, rice(Oryza sativa)
  misc_feature (71): n=a or g
tataatatttgtgtctgctaattatggctgacgatgcacgtcatcgtacgacaactaattataatagtcancttgcacgcttgattcttaatgttgacctg

SEQ ID NO: 52694 - DNA, 101 bp, rice(Oryza sativa)
  misc_feature (71): n=a or c
cccatgaagtaaataatgatttgtactgatcctaacagggtaaatttacggtgatattagacaaccatgcnaagttttattgtgagatataaaacgaagaa

SEQ ID NO: 52695 - DNA, 101 bp, rice(Oryza sativa)
  misc_feature (71): n=t or c
cgaatgcatgcaaagatctgatcgtgatgaacatggactggatttggtggttacctgaatgtgaatatggnatgcaacatctgaacggtggcaagtgcaag

SEQ ID NO: 52696 - DNA, 101 bp, rice(Oryza sativa)
  misc_feature (71): n=a or g
gcgtccctcaactctcagaaaccagtacaaatatggtcgtaaggggatttgaacggcggtttttgcctatntgacgttgacaaagtcaaaaaagtgagact

SEQ ID NO: 52697 - DNA, 101 bp, rice(Oryza sativa)
  misc_feature (71): n=a or c
cctaaactgatgccacatctcaatgcaagttctgattgtagtgatagagataacaaccggacccgggtttntatcaaatgcaattccaatgatattaccat

SEQ ID NO: 52698 - DNA, 101 bp, rice(Oryza sativa)
  misc_feature (71): n=t or c
aaacaatacaacggggagagctaacatgtatgtatgtgtgaagtgatatgaaggtagtggtttatccgtcngatttttgttgcttgcgtcgaacgtctaat

SEQ ID NO: 52699 - DNA, 101 bp, rice(Oryza sativa)
  misc_feature (71): n=a or c
ctgctaggaggaagctgttcaagttggtccttagggagggcgctattccaaggccatgcaagcagttattntggaagatgtgcaagaatcttcacttgctt

SEQ ID NO: 52700 - DNA, 101 bp, rice(Oryza sativa)
  misc_feature (71): n=t or g
ggacggctgcctagagttgttgcccttatgcatgtttcttcccgtgtatgatgtgtagggggtatttgtanggttagatttattctgcagcagtttaattg

SEQ ID NO: 52701 - DNA, 101 bp, rice(Oryza sativa)
  misc_feature (71): n=a or g
acccactttgtctctttgaccggctatttcgagtgtgttactctgaggtgaaatttttggcaaaaatactntgagtagaggagatcatgatgatctatatg

SEQ ID NO: 52702 - DNA, 101 bp, rice(Oryza sativa)
  misc_feature (71): n=a or g
aagattccaaatactattcgccatttatgccttgatgtgataagtctcactgttgttgaacagatctcccngtcaaagaaattacgcacacttatcatgca

SEQ ID NO: 52703 - DNA, 101 bp, rice(Oryza sativa)
  misc_feature (71): n=t or c
tggagttcatgaattccttgaaccatctgagctgcacgtatatatccggttgaagtagtacctcaaggtcntaggttcatatcctctatggatggattgtt

SEQ ID NO: 52704 - DNA, 101 bp, rice(Oryza sativa)
  misc_feature (71): n=t or c
cagctcctcaattggcgaacaccgtgccagtggatggtaagcccatgtggtattttgttgacgacgtggangaccactgtgtcaccctctgtcacgtccac

SEQ ID NO: 52705 - DNA, 101 bp, rice(Oryza sativa)
  misc_feature (71): n=a or g
tccgtgattcacaacttgttggactctcaggatacacaaaggaggtatggccacactcccaaatgattgtnttgaagtatgtttcttgtccagcatacatt

SEQ ID NO: 52706 - DNA, 101 bp, rice(Oryza sativa)
  misc_feature (71): n=a or g
agggaaattcaaatttcaaaatttgaatcccaagatttgagtttggaaagaaattttgggtctcaaagagngattttgagatctttggcacttagatcctt

SEQ ID NO: 52707 - DNA, 101 bp, rice(Oryza sativa)
  misc_feature (71): n=a or g
acaaggatcacaatcagagaaacagagaagaatgagaagaccacgatcactgtcgtgaatccggtctcgantggtttgtttttgctcttgctcgcagcgat

SEQ ID NO: 52708 - DNA, 101 bp, rice(Oryza sativa)
  misc_feature (71): n=a or g
agactacaagagagaagagagtattcgctggaaacgagggcatgcaaaatagcaatttcggttcaccgatntccagaagggaaaaagcaaacgaccaattg

SEQ ID NO: 52709 - DNA, 101 bp, rice(Oryza sativa)
  misc_feature (71): n=t or c
attcacatagaaaaccttagcaacacgctcagcaataacccacggatcatccttgagtcctagcttgctangatccacaactgtcaggccgtagttatcaa

SEQ ID NO: 52710 - DNA, 101 bp, rice(Oryza sativa)
  misc_feature (71): n=a or g
caaaagacacaagaaaatggaaaaggaagcttacaatgactggaagtcatcggttctctccaacaagcaanccaaaccaggtttggactctgaactgttct

SEQ ID NO: 52711 - DNA, 101 bp, rice(Oryza sativa)
  misc_feature (71): n=t or g
ggtgtcagatatcaagaatgcttgaaatgcaagctttctactcatgataggaagcccctcacttccagcantattactgtatcctccaggcaaggtaaaag

SEQ ID NO: 52712 - DNA, 101 bp, rice(Oryza sativa)
  misc_feature (71): n=t or c
tctttgtgtacacctgatcatattgagcatatccattttttaagggaaggtcatatatatcccttttgtanacatggtaaccttatctttaatgggtggtt

SEQ ID NO: 52713 - DNA, 101 bp, rice(Oryza sativa)
  misc_feature (71): n=a or c
tatgtagtggcctcatcttaacgttaaaatacatctcgaatcatgacttagtacaaacgttcgatcgaatnatgagtgctctatcttgcacataattagtt

SEQ ID NO: 52714 - DNA, 101 bp, rice(Oryza sativa)
  misc_feature (71): n=a or g
ttatcacacaatattagctatcttctcatcagccctgttcgatatctctttagtggagggttgaatgggancaacctggttggcagagttcttctgcacgc

SEQ ID NO: 52715 - DNA, 101 bp, rice(Oryza sativa)
  misc_feature (71): n=t or c
aggcgtgtttctactttcttatcctgagcaaaattaagagcctgtctagcagactagcactgctaccatangaaggaactagctggatggcccgcgcgatt

SEQ ID NO: 52716 - DNA, 101 bp, rice(Oryza sativa)
  misc_feature (71): n=t or c
accgcacagaaaaataggttttgtagtagtactcagtggaaggaattgtcaatgaaccacacaccacacanatatatatatatatactccctccgtactta

SEQ ID NO: 52717 - DNA, 101 bp, rice(Oryza sativa)
  misc_feature (71): n=t or g
cgaaaccggagctagtacgttgctctgaaaagtacgttgcttctagttgttgcatatgggaaataattganagtactccagtgacagttggaaattggaag

SEQ ID NO: 52718 - DNA, 101 bp, rice(Oryza sativa)
  misc_feature (71): n=a or g
cgttcatgtagttcattcatgcatttgacaagagaaacctgtggcacaaggtgcctgttccgatcggtttnctctacctgaacacccgccggaccctgctc

SEQ ID NO: 52719 - DNA, 101 bp, rice(Oryza sativa)
  misc_feature (71): n=t or c
agccaaacgacacctgagggacattatatatttgctttgcaaatgagggtatcacacgcacaagggggttnggaattttaatctctgaacccttattcctc

SEQ ID NO: 52720 - DNA, 101 bp, rice(Oryza sativa)
  misc_feature (71): n=a or g
atctagaacgtacgtacctcggtatacgtagcagctagtagtaggcatacatcgattgcaaattcaattcnctcgtgactacttcacgggcgaccctgcct

SEQ ID NO: 52721 - DNA, 101 bp, rice(Oryza sativa)
  misc_feature (71): n=a or c
tgttcacatgcagcgtgcagaggcctgagaagcaggtgaagaactgtaaaaataaaataaaaaggctggtnaagtctggagagtggtcaaaactgacaaac

SEQ ID NO: 52722 - DNA, 101 bp, rice(Oryza sativa)
  misc_feature (71): n=t or c
aagctcggcatctgctacacctgagccatcattgcggagcagatccgtgcaccgcgcatgaggtccatgtngccgctcggcggcacgtcctcgtggctcaa

SEQ ID NO: 52723 - DNA, 101 bp, rice(Oryza sativa)
  misc_feature (71): n=t or c
atatctttgttttcttttttgggaattgcttgtcttttcatgtttggtctcctttttttatagttcgttgnttctcgcctttgtgttttttttacagctcg

SEQ ID NO: 52724 - DNA, 101 bp, rice(Oryza sativa)
  misc_feature (71): n=t or g
tcccttgcgaaaacgcaggacgacttacttggagaaactaatgtgaagtcgtctggcaagacctcattcanagagccctacaagcctagctccaagacacc

SEQ ID NO: 52725 - DNA, 101 bp, rice(Oryza sativa)
  misc_feature (71): n=t or c
gccgccgccgggggatggcgaggaggaccacatcagccgcctcgcggacgacctcctctcggagatcatcncccgcctctccaccaaggaagccgcgcgca

SEQ ID NO: 52726 - DNA, 101 bp, rice(Oryza sativa)
  misc_feature (71): n=a or g
taataacacatctcaaattgaagacaacagagaagaggggaacttaggtttcacttggaaggactaaaaanaaaaaaaaagaaaaaaaaataattccgacc

SEQ ID NO: 52727 - DNA, 101 bp, rice(Oryza sativa)
  misc_feature (71): n=t or c
tgcagtcctgtagccatggaggaggacatgtcattgacagttggctcgcatgattcaggtcatggaactcnggtgacaaggtatctttcttggcatagtta

SEQ ID NO: 52728 - DNA, 101 bp, rice(Oryza sativa)
  misc_feature (71): n=t or c
ttccttgcaacatatttccccaggaaatcaaacccatgtgagtagagagcttcgatctcggcacgcttgcntgtctccaacatcagtgtcagctcagctct

SEQ ID NO: 52729 - DNA, 101 bp, rice(Oryza sativa)
  misc_feature (71): n=t or g
accttggtgcaggccatgatcgtggcagcaggagcaggtgatcgccggagtctggaacgacttgttcgccntggattggtgatttgcggtggcgagtcacg

SEQ ID NO: 52730 - DNA, 101 bp, rice(Oryza sativa)
  misc_feature (71): n=a or g
gttgttccttcagctgttctaggattcagaattgaatccgaatcgcttgttggcagaaaccccaaaatttncttgcccaaacttctcacactgtcaatatc

SEQ ID NO: 52731 - DNA, 101 bp, rice(Oryza sativa)
  misc_feature (71): n=a or g
tacaaaattacagatctgtacccttcccgccctttgggagggcattttttctaaaaaaaaatcgccctctngaagagcggcaagtggcttaaatgtaaaat

SEQ ID NO: 52732 - DNA, 101 bp, rice(Oryza sativa)
  misc_feature (71): n=t or g
taccccttatcccaactccaaaggcaaatatgtaggtttattccgggagttaggcgaggagttcatcgaanctagaggagaaagagcccccaaaaattcac

SEQ ID NO: 52733 - DNA, 101 bp, rice(Oryza sativa)
  misc_feature (71): n=t or c
tgtcctgatggagaaacactggcagagcaagatggggtgatactacttttcgatgcagaaaatccaaagcntgtttcttcctggtcagtaaagaaggtatg

SEQ ID NO: 52734 - DNA, 101 bp, rice(Oryza sativa)
  misc_feature (71): n=a or g
atgcctgatttctaaagcccatcgatgatagcagattgatgatccggactgcaatatacaaattaatcatnattggcttccaagtgaactaagtgtgtgtt

SEQ ID NO: 52735 - DNA, 101 bp, rice(Oryza sativa)
  misc_feature (71): n=a or g
tgaggaacaggagaatgtttccacatgtaagtaaagcagaagtttgtttcttttacagtcttatataaagngtaattttaccatctttgaaaaaaataccg

SEQ ID NO: 52736 - DNA, 101 bp, rice(Oryza sativa)
  misc_feature (71): n=a or g
cacccttgctctcaaggaacttcgtctggccaacgatgccaaattagtccagacagagaccgccctcgtcncggcaagcagcgctgctacctgttgccctt

SEQ ID NO: 52737 - DNA, 101 bp, rice(Oryza sativa)
  misc_feature (71): n=t or c
atccgatcccctcttcttaagcttgacctgggtgtagtgctcgacggagtgagcgttggtaagcaccctgngcccaccaatgatgaacccgctgctgctgg

SEQ ID NO: 52738 - DNA, 101 bp, rice(Oryza sativa)
  misc_feature (71): n=a or g
tatctttactgttagatggccagtgcttatctgtagttcagacatgcatttaactagcttatggttagtgnctaatgcttaaagttcgacatcggcagcct

SEQ ID NO: 52739 - DNA, 101 bp, rice(Oryza sativa)
  misc_feature (71): n=t or c
aaatgaatggaaaaatgacagactggtgaatggataataaccaaaatgccaaaattaatattgcgtacccnaatcgctgagttaataaagtaccgatatat

SEQ ID NO: 52740 - DNA, 101 bp, rice(Oryza sativa)
  misc_feature (71): n=a or c
agtgtagctagtacagtactgatctcctcctatacatggcaaaggagaaagctccttgctgcagtacaaanaacagcagcaaagcaccggcgacggcgagg

SEQ ID NO: 52741 - DNA, 101 bp, rice(Oryza sativa)
  misc_feature (71): n=a or g
ccggcatgatgttcgcgatcctccacaagacaaacatcgctatactcacgttgatgattcgtggccattgncagtggctggtgcaggaatttcttgctcgg

SEQ ID NO: 52742 - DNA, 101 bp, rice(Oryza sativa)
  misc_feature (71): n=t or c
ccatgcttatagatatgcgcacattttcagaaaatctaagggctttctgcaaaatcgccaattactttccncttttttttttctttcctcttttattcttc

SEQ ID NO: 52743 - DNA, 101 bp, rice(Oryza sativa)
  misc_feature (71): n=t or c
tgagccactccaactgttgttgctattgttgctccatgcgctgttactgttgtaactgctattgctgctcnatgcgctgttactgttgtagctgctattgc

SEQ ID NO: 52744 - DNA, 101 bp, rice(Oryza sativa)
  misc_feature (71): n=a or g
aacatgtgttagtacttattatggctctactgcctttgtgttgacatcacggttgctgttcagctcttatnccatttatacaatgcttagcctgaacatgt

SEQ ID NO: 52745 - DNA, 101 bp, rice(Oryza sativa)
  misc_feature (71): n=t or g
cccaaggagttactgaaacttgagtgctcattgtacagtaatttccagacaagtacatgcctcagtttctncaattttgcaaacccctctggaaaacttgt

SEQ ID NO: 52746 - DNA, 101 bp, rice(Oryza sativa)
  misc_feature (71): n=a or g
tttaattatttttcaaccctccacagtcagtcttttgatttagtaaaggtgctcaagagaccatggcgaanatgattaaagcactcggctttggagtaatc

SEQ ID NO: 52747 - DNA, 101 bp, rice(Oryza sativa)
  misc_feature (71): n=a or g
ttctcttgatatttagtcaatcgatagatatgtctgtaagggaagctattttaagccctcggtggtacgantctttgtttaatttcttggtttgcttatat

SEQ ID NO: 52748 - DNA, 101 bp, rice(Oryza sativa)
  misc_feature (71): n=a or g
cgctcgcacgtacctaagtacgtacgctatacatatgcaatctgagatcgctgcgccacacattatgtacngttggattaatacatttattgtaatatatc

SEQ ID NO: 52749 - DNA, 101 bp, rice(Oryza sativa)
  misc_feature (71): n=a or g
tctcccaatccatcgtgttgtccgtcaacagctgggtattgtatcggttggaacagagcatgacttagccnatatggcaagtggccgatacgatatgactt

SEQ ID NO: 52750 - DNA, 101 bp, rice(Oryza sativa)
  misc_feature (71): n=a or g
tgaattttcagttgaagagatgaaaacttgtactgtaccttttagaacaggggccaactgaaggatccaanataaaagagagttccagctagctttgattc

SEQ ID NO: 52751 - DNA, 101 bp, rice(Oryza sativa)
  misc_feature (71): n=t or g
tttattatgtgcttattaaatgttcataaaagtttgttcgctctactttttcttcattcgcagatcaatcntgtggtcttgaatggtgtgactgttatgca

SEQ ID NO: 52752 - DNA, 101 bp, rice(Oryza sativa)
  misc_feature (71): n=a or g
tcggactcgggctatagttgaagaatgtaatcagacactcgaacgaggaaaatgaaatgatcccttcaaangaattgaacctgactttagaaaattttttg

SEQ ID NO: 52753 - DNA, 101 bp, rice(Oryza sativa)
  misc_feature (71): n=a or g
ctggaggtgggggagggggttcaagtttggccttcacctcatgtggatcaacgaattcagcaactaagganctgccattgtttggaggccattggagattg

SEQ ID NO: 52754 - DNA, 101 bp, rice(Oryza sativa)
  misc_feature (71): n=t or c
ctcaaaatcacatgtgcagacatcagcccgtggtactacgtcggatcaggttatttctgatgggtccaaancctcacctttgatgagtttagccctagtca

SEQ ID NO: 52755 - DNA, 101 bp, rice(Oryza sativa)
  misc_feature (71): n=a or g
ctaaatgtcatgtcatggtgagttctaagcttttacctgttcaaatacaaaccaattcctctcacaacctnaggagctacatgtcaaattcaaaatccttg

SEQ ID NO: 52756 - DNA, 101 bp, rice(Oryza sativa)
  misc_feature (71): n=a or g
ttaatttgggttaattgctaacaagaagccaagagagaaagagggcgtatccgataaaaatgagctaagtnttaaaaacttgtaaaaatcatacctatttt

SEQ ID NO: 52757 - DNA, 101 bp, rice(Oryza sativa)
  misc_feature (71): n=t or c
tgtttcattcgcttgatgaactatggagccgtgtacagtactcgtccatgctaagggtgagttcgaatatngagaagattggaaagatatgcaaaaaaaag

SEQ ID NO: 52758 - DNA, 101 bp, rice(Oryza sativa)
  misc_feature (71): n=t or c
gctttccacgccgccaaagtttggaaagaagaaatctgacaccatcaaaatcctgtgctttctccctcgcncatccatttgtagctgtgtttgaaatctga

SEQ ID NO: 52759 - DNA, 101 bp, rice(Oryza sativa)
  misc_feature (71): n=a or g
ccgatctgcttgaaaagtcccttgtgatctcgttactttaaagcctaagggtttatttggttggtgaaatnaaaaattttttatgtcatattggtttgacc

SEQ ID NO: 52760 - DNA, 101 bp, rice(Oryza sativa)
  misc_feature (71): n=t or c
atccttgcaatggaccccctacacagatttctcaagattataaccgtcgagggccacctaagcgagttcgnggaccgcagcgtgcgcttcagatgctccct

SEQ ID NO: 52761 - DNA, 101 bp, rice(Oryza sativa)
  misc_feature (71): n=a or g
accactgtttaaatcatgtcaccaactgagtgtaagtagtttgaatgcgttcaagtatatagaagtttgtnttttatacacaggtagttgaagagttactc

SEQ ID NO: 52762 - DNA, 101 bp, rice(Oryza sativa)
  misc_feature (71): n=a or g
gctgccatattctctttctcttcttcctcccttatctttcctcctcccccatggagaccgtcatggctgcnacaagcaagggtgtgtcgtggtgggggagg

SEQ ID NO: 52763 - DNA, 101 bp, rice(Oryza sativa)
  misc_feature (71): n=t or c
cactcgaacgaagaccgagactgtgatcaccaccacaaccgtcatattcgcgacgatcgtgagcgacggangccggccgataccagtcgagggcgccgcca

SEQ ID NO: 52764 - DNA, 101 bp, rice(Oryza sativa)
  misc_feature (71): n=t or c
tcaacaccgcacaacccttttgctgcaaaggacatgagacaaaaataataaatagtatatacgcaacttancttcctgtaaaatagacaacaaaacaaaat

SEQ ID NO: 52765 - DNA, 101 bp, rice(Oryza sativa)
  misc_feature (71): n=t or c
ttgcagctagctagctactcctacccccgatgcagctatctgaagttcctctttagcttaggcaataatgntcagattagtataagcctaaacagactaat

SEQ ID NO: 52766 - DNA, 101 bp, rice(Oryza sativa)
  misc_feature (71): n=t or c
gcagcttgcatatttgtaagaaatctaagtgttacaacatacgtgcattaattaattattaatttactttngacaattactaattagccattacaatccag

SEQ ID NO: 52767 - DNA, 101 bp, rice(Oryza sativa)
  misc_feature (71): n=a or g
cattgttcacaggtggttgtcaaatgcctgtgtaattaggttagcacccacatgtgaacatattttcgagntatttgatctttgtttttaaatgcattttc

SEQ ID NO: 52768 - DNA, 101 bp, rice(Oryza sativa)
  misc_feature (71): n=t or c
ccgaggcccatcgccgcattcgttgtcgcagctcccaccagatcggcgcgcgatggtgggggatatgacantggatctgttgcgttgagccccaccgccgc

SEQ ID NO: 52769 - DNA, 101 bp, rice(Oryza sativa)
  misc_feature (71): n=a or g
gtatttccagtcaaaaaaaaagtacctaagggcaagaaccattaaaggcatttcatcattcgcagttgccntgggggagaatatcttctggagtggtccat

SEQ ID NO: 52770 - DNA, 101 bp, rice(Oryza sativa)
  misc_feature (71): n=t or c
atcctttatagagagcatgagactgagcatagcagagctactaatagcgagtgatttccatgcatgatgcngggaaaaagactctgcggtaagatttggaa

SEQ ID NO: 52771 - DNA, 101 bp, rice(Oryza sativa)
  misc_feature (71): n=a or g
atcaccaatggctagcaaatccttgattccattcaccggctctttatccaattccacatacgacctcaccngagagccgacaccggcgaatcaattgatcc

SEQ ID NO: 52772 - DNA, 101 bp, rice(Oryza sativa)
  misc_feature (71): n=a or g
gtttcaattgatcttagactgggccatataattaagttcaggccttcaatctgtttagacgtacgtatgcntctattttgatttggattaagcgtagttct

SEQ ID NO: 52773 - DNA, 101 bp, rice(Oryza sativa)
  misc_feature (71): n=t or c
gggtgaaactccctagtgttcggattatttgaggactctcttattcaggtcaagttttggatgctgcctgnatcgcttaatgtcatagtaacatgctcata

SEQ ID NO: 52774 - DNA, 101 bp, rice(Oryza sativa)
  misc_feature (71): n=a or g
gaagattatcgaactaatggctactatgtgctaacatgcagtatctgcatagcgcggcgatgactgaaatntttgagcacattggtttatcagagaagcag

SEQ ID NO: 52775 - DNA, 101 bp, rice(Oryza sativa)
  misc_feature (71): n=a or c
tggagacgactcgagtcttccccccacccacccaacagacccaactgattgatttgatcacctatggctcnatggctgtggccatgtctgacccggccttc

SEQ ID NO: 52776 - DNA, 101 bp, rice(Oryza sativa)
  misc_feature (71): n=t or c
aactagtttatatatatagttgcccatttgcatgactataatcaacttgttattaaatgtgtcactactanaaataagatttttccaaacgggcattttga

SEQ ID NO: 52777 - DNA, 101 bp, rice(Oryza sativa)
  misc_feature (71): n=t or g
agtcagatattaatatctgcattctgcaatatgcctgcacacccatccacgtcggcagataaggacggaanggaagagggccacgaggagttcatatccat

SEQ ID NO: 52778 - DNA, 101 bp, rice(Oryza sativa)
  misc_feature (71): n=a or g
atgcatgattgatgcactgtcaaaggaagaaaatatgatccaagctttaaactgctgggatcagatggttnttgatggctactctccaaacactgtaacac

SEQ ID NO: 52779 - DNA, 101 bp, rice(Oryza sativa)
  misc_feature (71): n=t or c
acgcggtttgggcctgggtctttgggcccgtggactcatagtgggcttattgttttcagtttttttggaanaagttcactctcagtacctcaacttcagat

SEQ ID NO: 52780 - DNA, 101 bp, rice(Oryza sativa)
  misc_feature (71): n=t or c
tttaggctagctacaaagcaatgagaggctgctgggccatcatactagtagtatcagatacttcctccgtnaaaaaaaagaaaaaactcaatctgagaggg

SEQ ID NO: 52781 - DNA, 101 bp, rice(Oryza sativa)
  misc_feature (71): n=a or c
tatattcatttaacattgtggcccatgattcctcaagctccgtttctgagttaggtccttgcatgcacttnataaacatattttgaaatgtttgagaggta

SEQ ID NO: 52782 - DNA, 101 bp, rice(Oryza sativa)
  misc_feature (71): n=t or c
ccttgtcgtgtgctaggctatagagaaaccagcaactatgcagcataggatgcaaccatattataaaggancaatgcttctccaagtgagggcattttatt

SEQ ID NO: 52783 - DNA, 101 bp, rice(Oryza sativa)
  misc_feature (71): n=a or g
gactcctatctacattcttgtctggtagtggcacatgtgatcctcatagggttatctacctctactagaanatcagggttatctacctctactagaagatc

SEQ ID NO: 52784 - DNA, 101 bp, rice(Oryza sativa)
  misc_feature (71): n=a or g
cggtgaagaagcggcgcatccgctccgacatgatgtccatgttggggaggcacttggcctcggttatccanatgtcgaggtcgccgtgcaggagcacggcc

SEQ ID NO: 52785 - DNA, 101 bp, rice(Oryza sativa)
  misc_feature (71): n=t or c
tctgaggagcctcccgcttatcgatcgccaaacttgtcgcatatcggctcacgcttctctttttttttccnttccttttgtgttcctttgttttctcaacc

SEQ ID NO: 52786 - DNA, 101 bp, rice(Oryza sativa)
  misc_feature (71): n=t or g
cttccttccttccttcctcctcggcaacctcgaccgatcttctcttcgatcgttttcagcttcagacacgnatcagagcagagcagggtcgcaagaacaca

SEQ ID NO: 52787 - DNA, 101 bp, rice(Oryza sativa)
  misc_feature (71): n=t or g
cgatctcaaccttacgaggcggatctagaggtggtattgggaccacccaaaaaagcattagcccaatacanatatacatatgtgaaaagattttttttgga

SEQ ID NO: 52788 - DNA, 101 bp, rice(Oryza sativa)
  misc_feature (71): n=a or g
ctgtttcggaatccacgcggtgtagcgcgtgaaatcttttctagtagctctaatacaaacaaatgcagtcncgagatactcgttcgtacagttggaattaa

SEQ ID NO: 52789 - DNA, 101 bp, rice(Oryza sativa)
  misc_feature (71): n=a or c
tgatttggttgcttgtggactgattgactgactcactcactgaatgattggattagcttttgtgagtgggnttgtggggattctgtgcttcagcataattg

SEQ ID NO: 52790 - DNA, 101 bp, rice(Oryza sativa)
  misc_feature (71): n=t or g
cacagggacattaataacaaaaacttaggagtgctcactaacgataacaaatggacgtgcggagagaaaanatgttctggttttcttatagtagttgttta

SEQ ID NO: 52791 - DNA, 101 bp, rice(Oryza sativa)
  misc_feature (71): n=a or g
ctcccaattactccctccgtcccaaaaaaaaatagcaaactctggctatgtatctggacgatactgtccanatacatagctagagtttatctttttttttt

SEQ ID NO: 52792 - DNA, 101 bp, rice(Oryza sativa)
  misc_feature (71): n=t or g
ttccttgagttgtgtttgcttttattgaaccaagccagctcacacaagtcaaaaaccgtgaaattcaagcngtttttgatgcgtttgctataaatatttga

SEQ ID NO: 52793 - DNA, 101 bp, rice(Oryza sativa)
  misc_feature (71): n=t or c
gagtgagttgactgacctgaggacgttgacacggaggttgaaggagagatggaggaagagctggtagaggngcccgaggtcagcagcgttgccgtgggagt

SEQ ID NO: 52794 - DNA, 101 bp, rice(Oryza sativa)
  misc_feature (71): n=t or c
tgcttgagccacaaccagtcgagctgtggggcaagattaccaaccgagctaggcaaacttcctttgagacngttcccatccaagagtaattttttcagttg

SEQ ID NO: 52795 - DNA, 101 bp, rice(Oryza sativa)
  misc_feature (71): n=t or c
ctattatactacatgtttagctagacttttggcatgcccaagctctaacaaatgatttttgcacctaaatngatttcaattaggtgggcgagagtggggtt

SEQ ID NO: 52796 - DNA, 101 bp, rice(Oryza sativa)
  misc_feature (71): n=a or g
acatggtagctagctctgcaggcatgcattggccatgtagaaactagacatgatcattgagatggagttcnaggagaagataacattggaataaagagtga

SEQ ID NO: 52797 - DNA, 101 bp, rice(Oryza sativa)
  misc_feature (71): n=a or g
gtcgcggacgtggaggatgcccgaagtgacgggctcattgcggcgaagcttatgcaggtcggggagggacncggagaggtcggagttgggaaggacgggga

SEQ ID NO: 52798 - DNA, 101 bp, rice(Oryza sativa)
  misc_feature (71): n=t or c
gtaaccatttggtttgaagaggatgctagtcctgttccgtcagcaccatacatcactaaatttttcgggangtggcgcatattgccaggcatcccaagtcc

SEQ ID NO: 52799 - DNA, 101 bp, rice(Oryza sativa)
  misc_feature (71): n=a or c
aggaaagaagccgacgccgccatgggcgtcctcttcttgttggctcgccgcgtgcgtgtcaactccgagangcaactttgatccgagcggcggcggcggcg

SEQ ID NO: 52800 - DNA, 101 bp, rice(Oryza sativa)
  misc_feature (71): n=a or g
ctgctcatacccattagtaaggatctcttcttcagtgaccttcttgttagctaccttttgatccccctctntttgttgatcaatcttaagggttccttcaa

SEQ ID NO: 52801 - DNA, 101 bp, rice(Oryza sativa)
  misc_feature (71): n=a or g
tctcagtcaacaaataaattaaaaaataaagtaggatccacgtgtcatcctctttctctactactgtcagngttatggataccacatacctaatagtagtt

SEQ ID NO: 52802 - DNA, 101 bp, rice(Oryza sativa)
  misc_feature (71): n=a or g
ttagatggaaattcatttggcaccttaaactttaaagccgagcatacaacccaccaaaccttgcaatactntttatattatcccataaggtggttttggac

SEQ ID NO: 52803 - DNA, 101 bp, rice(Oryza sativa)
  misc_feature (71): n=a or g
cactctagctgttggttttagctcttctggcacctattgtgccgatctatatgtgtgtttttaagtagtgnaaagggcgatgcgctcgatgttgtggtatg

SEQ ID NO: 52804 - DNA, 101 bp, rice(Oryza sativa)
  misc_feature (71): n=a or c
tttgcatgggcacatggaatgtatagataaacccagagggaacatttgggggcatgcggatgcaagaaaanaaatattcagattatatgaataaatgtgag

SEQ ID NO: 52805 - DNA, 101 bp, rice(Oryza sativa)
  misc_feature (71): n=a or g
aaaatgcccctagcgtagagatcctgcttcctcctctccaaggagcctgatctgtctccaccaggtgtaangccggtcgcgcgggtggtactcctacgatt

SEQ ID NO: 52806 - DNA, 101 bp, rice(Oryza sativa)
  misc_feature (71): n=t or g
gcaactaagcataaaaaagatcgtatattttgtgaaagaaaacaagcaggaacctgcattgggaaccattnatctgatcacctttgagttctgatggtttt

SEQ ID NO: 52807 - DNA, 101 bp, rice(Oryza sativa)
  misc_feature (71): n=a or g
tcccgcattggtgcatcgcgtgatgaaaatgatagtgctatggccaagctcgagatggaacttgggagacnccgatgggatggccagatgatgtcaaagaa

SEQ ID NO: 52808 - DNA, 101 bp, rice(Oryza sativa)
  misc_feature (71): n=a or g
tcagatctcttgtaggtttcccagtctactataaaatgatctgcatgccatataattttgtgcctttttcngatcaagtaaaaatcaatcgaaggcatgga

SEQ ID NO: 52809 - DNA, 101 bp, rice(Oryza sativa)
  misc_feature (71): n=t or c
acaaacagggctttaattgaaacacgaagcggattaggatcacgtatcaaatggatatgaaaaacatcttnaatttttataatagtagagatatttgagaa

SEQ ID NO: 52810 - DNA, 101 bp, rice(Oryza sativa)
  misc_feature (71): n=a or g
gaatggataaaatttctcgattcgtgaatcgatggtgacaaaagatatgagctggtttattttgggacatngtttaaactctagaagttgattgattttcg

SEQ ID NO: 52811 - DNA, 101 bp, rice(Oryza sativa)
  misc_feature (71): n=a or c
tttgttctcacatctcaagcatgttgggagctcatgaatgcattcaattggttgtttatggcattgggagntttgaatttgatgtgaagtcccaatatcag

SEQ ID NO: 52812 - DNA, 101 bp, rice(Oryza sativa)
  misc_feature (71): n=t or c
gcgcctgatgtggttcacaaggtgaaggatgctgcagacaggctacactggcacagcgaaatcgttgacantgagaatgggggcctggatcctgagaagct

SEQ ID NO: 52813 - DNA, 101 bp, rice(Oryza sativa)
  misc_feature (71): n=a or g
gcgtgcattccgacagccagagatcatccgccgcgagctctaagtctaacctgcggccgacgaagagcatncaggtgagggcgagctccaaggacgtcggc

SEQ ID NO: 52814 - DNA, 101 bp, rice(Oryza sativa)
  misc_feature (71): n=a or g
ggggaattttctattttttatgcgagagtatgcagtatgcactgcacacgaagtgagggagggaaggggangatgaatgactacacttttaagtaataaaa

SEQ ID NO: 52815 - DNA, 101 bp, rice(Oryza sativa)
  misc_feature (71): n=t or c
agagcaaggtgtacttggtggtccaatatgtacaaattgctcatgcatcctggaggggagattattacganatacatatattgtaccattaatacagcctt

SEQ ID NO: 52816 - DNA, 101 bp, rice(Oryza sativa)
  misc_feature (71): n=t or c
gacactggttgtccggcttggtttcttgcttagtcttgatctctccgattcggaaggggatttctgttggngtagggtttgtacacggttcgtgcccggag

SEQ ID NO: 52817 - DNA, 101 bp, rice(Oryza sativa)
  misc_feature (71): n=a or g
ccgatgataagatggccattgctgtaccaggaaagcaaaacattgttagcattgatagcattgaagacgtntcagattacaaccaatacgacgacgtcctt

SEQ ID NO: 52818 - DNA, 101 bp, rice(Oryza sativa)
  misc_feature (71): n=a or g
agagtcattggagggagaggcaagtcataatagctgttgcacaagtagttctaacaatgtacatatgtagngccaaggccataaaaaagggagaatgcccc

SEQ ID NO: 52819 - DNA, 101 bp, rice(Oryza sativa)
  misc_feature (71): n=t or c
atccatccttgagttatgaatgctaatataccgctgcctatcaaggtcatatatcatgtccgtcaaaactntcttcaagtcaggattttgacccaccgaaa

SEQ ID NO: 52820 - DNA, 101 bp, rice(Oryza sativa)
  misc_feature (71): n=a or c
cctggtatagcctcgtacgagctatagatggcttgtcttgcttgcttgcgacacaagaagaagaagaaggntctgttttcaaacttttaacctctcacatc

SEQ ID NO: 52821 - DNA, 101 bp, rice(Oryza sativa)
  misc_feature (71): n=t or c
agttcttttagaagggctattttgggggataacttaaaaacttggttggaggtaatagcaagagtaatacnggttaatctgacataacaaaatgattcttt

SEQ ID NO: 52822 - DNA, 101 bp, rice(Oryza sativa)
  misc_feature (71): n=a or c
tgtttttatgtagtagagataagtaggcaagcaaagcataatggcgtgattcttaaacaggaaaatacacntattttagaagatctaacaatgcatcaaac

SEQ ID NO: 52823 - DNA, 101 bp, rice(Oryza sativa)
  misc_feature (71): n=t or c
tatatctatctcttatggttttctttttatatatacatggccatttttacacacaggaaatgtagaaggcngaccaaagttagtcatcatataggtactgt

SEQ ID NO: 52824 - DNA, 101 bp, rice(Oryza sativa)
  misc_feature (71): n=t or g
taatcctttcattcattcccctctcactctctcttctcaccatgcatcagcagttgccacgatgaggtcgngccggggagcttggtggagggagcggatca

SEQ ID NO: 52825 - DNA, 101 bp, rice(Oryza sativa)
  misc_feature (71): n=t or c
ggaagccccagatctaggaggagcgacggggaatggccaccaaacctgggtcgaaagctgctccgcaatangccccccaacacactcgctaataagctcgg

SEQ ID NO: 52826 - DNA, 101 bp, rice(Oryza sativa)
  misc_feature (71): n=a or g
cacttctgctagtctgggtaacaaaactaacctggcagatcgcagatcctctgggcaattaagaatggcancatcctctgaagtgaagaaaacacaaggaa

SEQ ID NO: 52827 - DNA, 101 bp, rice(Oryza sativa)
  misc_feature (71): n=a or g
agccgtttggatagcattggacgtgttggtcatacatgcatgtcaaacacatagaagagcccaaacagagngagagaggggggtggtttgatcgaatcatt

SEQ ID NO: 52828 - DNA, 101 bp, rice(Oryza sativa)
  misc_feature (71): n=t or g
ggttttgaaatgcagggaggggatatgagatttgggggtgaagagtagatcagaaggttgcaagctccacnctatatgcaataggaaaaaaatacgaatta

SEQ ID NO: 52829 - DNA, 101 bp, rice(Oryza sativa)
  misc_feature (71): n=t or c
actgatcgataacgaccgtcaacacttacccaaccgcattgaagaatgaccatttttgtataagttaaggngctgtttgttttttataaagcaattcattg

SEQ ID NO: 52830 - DNA, 101 bp, rice(Oryza sativa)
  misc_feature (71): n=t or c
gaggtgactgttgcaaaatggtgtgaggagagagacactccatttttgtctcttctctctcctaatttggngcatccgccacttttggagtgcctggtagc

SEQ ID NO: 52831 - DNA, 101 bp, rice(Oryza sativa)
  misc_feature (71): n=a or c
ggccttttattgcaaaggtataacattaataattcctgcatgcatagctatagtgttagggaattaaaatntaaagtctatagcatcgtcgtaaattcatt

SEQ ID NO: 52832 - DNA, 101 bp, rice(Oryza sativa)
  misc_feature (71): n=t or c
ctagaacggccctgactgcaaatatctgttcaggttaagtttcagggctgagagcatgcccaacagattanttattctattccctatccttaaattaaaga

SEQ ID NO: 52833 - DNA, 101 bp, rice(Oryza sativa)
  misc_feature (71): n=a or c
atctgataggaccaatataaaagaaaaaacagccacgtggacaagaatagcgctaaaagtgacgcaggggngagagagtagggatcgggtgacaaacgtga

SEQ ID NO: 52834 - DNA, 101 bp, rice(Oryza sativa)
  misc_feature (71): n=t or c
agaatgctgatctacaaattctcgcaaaaataccaagcatatgctgtctaattctcttgggcaattcttangatgataccctgcttaccttcaacaaagga

SEQ ID NO: 52835 - DNA, 101 bp, rice(Oryza sativa)
  misc_feature (71): n=t or c
agttgctctgttgacttttagaggacgttttttttttttgaaattgttcttcaagaatgaagtttgataantaatttcccataaaatgtatttttaatgga

SEQ ID NO: 52836 - DNA, 101 bp, rice(Oryza sativa)
  misc_feature (71): n=a or g
gatcacgagcggcggttgcgcgaccatggcgatgacgacgggttttgttgggtttatttttctttttttcntgcgggtggtataacttgaccgcacaggat

SEQ ID NO: 52837 - DNA, 101 bp, rice(Oryza sativa)
  misc_feature (71): n=t or c
gtaggcaaataggcctatattgttgaattttgatttgcatcagccttttttggcagtagcacgatgatccnaaagtttaggttataaagggataatgtccc

SEQ ID NO: 52838 - DNA, 101 bp, rice(Oryza sativa)
  misc_feature (71): n=a or c
aaaccctaaaatagtagactatagctaaacaatcaaatgatgggtggcacggctccagctacaacttcatntctcttaaactaaagcccaaccaaatattt

SEQ ID NO: 52839 - DNA, 101 bp, rice(Oryza sativa)
  misc_feature (71): n=a or g
tacaccttacacagacctctagttatcgttaggaataagttcactggccgtccttttacccgagtctgttnaggtcctataaccgtaatatcataaatgta

SEQ ID NO: 52840 - DNA, 101 bp, rice(Oryza sativa)
  misc_feature (71): n=t or g
tttttctgttattcatttgtagatttgtgaaacgagtaaatgctataaattgtggtgctctatggatctgncaatttgggattcacttttgtgatttggga

SEQ ID NO: 52841 - DNA, 101 bp, rice(Oryza sativa)
  misc_feature (71): n=t or g
tcgttggggataggagtttcttagagccgagatagaagatgcgatagggagagagtgatctcgcaagtttngtgtggcgtgattgtgatcttgaagatgga

SEQ ID NO: 52842 - DNA, 101 bp, rice(Oryza sativa)
  misc_feature (71): n=a or c
aaaaaaacctcgcaagtcactactccaggtcttaaacaataatccgacgtggcaggtcaagcaggtagtgntaaagaggtactagcacacgtgatgataac

SEQ ID NO: 52843 - DNA, 101 bp, rice(Oryza sativa)
  misc_feature (71): n=t or c
ccatgtgcaagtgtgccttgcatccacatcgtccttagttccttacacattaagcaccttgcagttgatgntaacatgcttgtcctcgtgtgaaaactaga

SEQ ID NO: 52844 - DNA, 101 bp, rice(Oryza sativa)
  misc_feature (71): n=t or c
tcaaacgttgaacatagaaatacgttaatgaatttattttacgatagagggtaaacctgcaaggctgcacnccgtgcagtcgtacttgcccaattgcgacg

SEQ ID NO: 52845 - DNA, 101 bp, rice(Oryza sativa)
  misc_feature (71): n=t or c
ctagccctacgaacgggcggcggagggggaaaaattggagtcggtgagaaagatggtgagcagcatgaagnttcctttggtggatggggaggagcagtcgt

SEQ ID NO: 52846 - DNA, 101 bp, rice(Oryza sativa)
  misc_feature (71): n=a or g
tcgacaggccgacgagctccggcgaggacttggtgatgacaacattcttcattttctggctgatctcctgntaatgttcgttcagaagtttttaaacagaa

SEQ ID NO: 52847 - DNA, 101 bp, rice(Oryza sativa)
  misc_feature (71): n=a or g
cctcgagaagttggatcggattttttgtaacccagatggcgatatgctcttctctaaccacaacctacaanctctctcttcctccaactctgaccactgcc

SEQ ID NO: 52848 - DNA, 101 bp, rice(Oryza sativa)
  misc_feature (71): n=t or c
gtgaagtgcaccttcgagaggatgctcgcgtaccatctcactgggaagaagcacctgaaacaggagaattngcagttgtcctgcgagatctgcaaactgca

SEQ ID NO: 52849 - DNA, 101 bp, rice(Oryza sativa)
  misc_feature (71): n=a or c
ccatatgcatgcagtggctgttttcaaagcaaggtaatgtaaaacctgaagctagctatagtgagtactantccatcccaaaatatatcaatctatctaga

SEQ ID NO: 52850 - DNA, 101 bp, rice(Oryza sativa)
  misc_feature (71): n=a or c
tgaatgtgaaggtgtgatcaacaaatgaatccagcagctgttggtaagtactgttcatggcatttgatgcntctcccagtttggagcttagatgcacctga

SEQ ID NO: 52851 - DNA, 101 bp, rice(Oryza sativa)
  misc_feature (71): n=t or c
gtattcgggtggtggggatcgtttgtcaggagaacaattgaattctgttgctgctgggcgtactgctcatngatcgagtggcactctcctgctatgatgaa

SEQ ID NO: 52852 - DNA, 101 bp, rice(Oryza sativa)
  misc_feature (71): n=t or g
tactattggtgccctgtcctcttgtgcgttcgtttcttaatttcgttcgtgcgcatggtttctagctatanctataccttacattgggacatatatggaag

SEQ ID NO: 52853 - DNA, 101 bp, rice(Oryza sativa)
  misc_feature (71): n=t or g
tatgatccattcaaatcatctcctttctgattattagcactctgatccaatgcacgagttatctcctcaanaattgtgtcaatgttttccccactggtttc

SEQ ID NO: 52854 - DNA, 101 bp, rice(Oryza sativa)
  misc_feature (71): n=t or c
tccaagcggccgatgaaggttgatggccgaacagccgatgctagacgtacgagaggttttcagatgaattnggccaaggttataaataagtatcagaggaa

SEQ ID NO: 52855 - DNA, 101 bp, rice(Oryza sativa)
  misc_feature (71): n=t or c
acgctagaatttacagtatttgttcaatcgtcgaaaaatccttcaaaaaatacctcgattctaagggatgnattaggtgtcattgcgcgatgacaattttt

SEQ ID NO: 52856 - DNA, 101 bp, rice(Oryza sativa)
  misc_feature (71): n=a or g
agctccttgcccccgaggattaccataactcagtactattatctgtttagagcttttctggtgaggactantacagtgtggtttgttcactctgttgtttg

SEQ ID NO: 52857 - DNA, 101 bp, rice(Oryza sativa)
  misc_feature (71): n=t or g
tcttctccttgcagcaaccatcaatgctacatgactttgcaatcacggagcattatgccatcttccctgantcgcaacttgtcatgtgtccgatgaacatg

SEQ ID NO: 52858 - DNA, 101 bp, rice(Oryza sativa)
  misc_feature (71): n=a or g
cgatctgctgctgcttgttttgttctctgatgccgtttgttcgaatgcaattgcagtcaataccatgatgnggattgctatcttgcaaaggtagttcagga

SEQ ID NO: 52859 - DNA, 101 bp, rice(Oryza sativa)
  misc_feature (71): n=a or g
agttataatcactctcttcgctattatcctcttggacctcttctgcatctgctccgaagatggcaagtctnggatggttgggatttgcacttgcttctctc

SEQ ID NO: 52860 - DNA, 101 bp, rice(Oryza sativa)
  misc_feature (71): n=t or c
aagagagtgagtaagtaacttgtgactaaaaaaaattatatatgcagtcttatattagctacttaaaaccngatgaaaaaataaactatatgaaattcgaa

SEQ ID NO: 52861 - DNA, 101 bp, rice(Oryza sativa)
  misc_feature (71): n=a or c
cgtcaaattggatatccaacttgttgtaagtaactggtttccgccaaggtacagctctgaaagtgtagttnggttgataactagagcagcaacgccttcat

SEQ ID NO: 52862 - DNA, 101 bp, rice(Oryza sativa)
  misc_feature (71): n=a or g
tgttcttcgtagttctgtcagcctttaaaaaggcaagcctgaagatcctttccttatgacactagctatcnggtgttatttatgaaagagatgattgactt

SEQ ID NO: 52863 - DNA, 101 bp, rice(Oryza sativa)
  misc_feature (71): n=a or c
gatgatggcttgagatctctacccaacagtacaccacgtacagcaccagataaagaatcttcttttggaanacttgcactagccaccatagaacttaggaa

SEQ ID NO: 52864 - DNA, 101 bp, rice(Oryza sativa)
  misc_feature (71): n=a or g
gaatcttgtgtccctgatcattcagaagctccttaccgcgacaacgatgacgcatcggaggattgctctcntggtgaaagaatggatggtgaaggaagcag

SEQ ID NO: 52865 - DNA, 101 bp, rice(Oryza sativa)
  misc_feature (71): n=a or c
agggcttttagttgattcaactgaccaaatttcatatttggctgctgattctccgtccttcatgaatgatnaaatcccatgcaatacaatgaagtctgcct

SEQ ID NO: 52866 - DNA, 101 bp, rice(Oryza sativa)
  misc_feature (71): n=a or g
aactaaactaaaacttatatatacctaatgattttccaaacatgcaacaaatcgaaaaaaaaaaacacaanagagagatagagagagaaaaagaaaaggaa

SEQ ID NO: 52867 - DNA, 101 bp, rice(Oryza sativa)
  misc_feature (71): n=t or g
agctcaacaattccaggacctgatgccataacactgggtaattcaaaccggaaagaacaagcagcacattntcattgctcaatttcttggcaagcctctgc

SEQ ID NO: 52868 - DNA, 101 bp, rice(Oryza sativa)
  misc_feature (71): n=a or g
aggtcacctaagctaataaccttgtccgataatactagtacatgttaacaggatttctctatgtgcatatntatgtaatggatgcatgattttcaagcaat

SEQ ID NO: 52869 - DNA, 101 bp, rice(Oryza sativa)
  misc_feature (71): n=t or c
aagttcatctcaagcgaacaaccaaacatctgcacatatatctctaaagccagatcaaactcaggctgaangagagaggtgaatcaggagtgctgacgccg

SEQ ID NO: 52870 - DNA, 101 bp, rice(Oryza sativa)
  misc_feature (71): n=a or g
ccacctccggaacggcaacaaaagaggagggcaccttacgtcgcgagaagccttgatctgcggcgactccntgtccgacatcgtcggcgacatggcctccg

SEQ ID NO: 52871 - DNA, 101 bp, rice(Oryza sativa)
  misc_feature (71): n=t or c
gataagatctgcaactttgtagctaggtgacaacctttcattatagagattgtttagagacccaaatattngttacaagatctcaaatttattattataaa

SEQ ID NO: 52872 - DNA, 101 bp, rice(Oryza sativa)
  misc_feature (71): n=a or g
ttcttcccctcccccctttcattccaagcataatcttaatcctaattggttggtccaccgccatctcttcnaagctagaggagaatgaggacaaaacatga

SEQ ID NO: 52873 - DNA, 101 bp, rice(Oryza sativa)
  misc_feature (71): n=a or g
tctgaacccgcactctacctagtcacgtccatataggcaagatgggtaagcagatgggcaagacaaattcngatggaaaaaattccaccttgaaattttta

SEQ ID NO: 52874 - DNA, 101 bp, rice(Oryza sativa)
  misc_feature (71): n=t or g
ctcgttgctcctttgcatcaaatgacgagcatttaccatgatttcattcataacaagctgcagagcttcgnaaggatcggtagatattttgttaattttgt

SEQ ID NO: 52875 - DNA, 101 bp, rice(Oryza sativa)
  misc_feature (71): n=a or g
gttgttgttgtccggcatggccgatcaaacagcaactctcctgcacaattccacaaaccaaaatccatcanccatcgaatcaagaaacgcgagcctatccg

SEQ ID NO: 52876 - DNA, 101 bp, rice(Oryza sativa)
  misc_feature (71): n=a or c
gtaaataacaactcaaatagcatacacacaggcataaactgaatttctcaaatcataaagacacctgatanaacgggtgtggacaagtcacagatctacgt

SEQ ID NO: 52877 - DNA, 101 bp, rice(Oryza sativa)
  misc_feature (71): n=t or c
catcctcgccgtgaaggtgctgtacttgaccagcttgggcagccacgccttcttcttcctcttgccgtcgncgccgttcatcctcgcggtgaggtaggcgc

SEQ ID NO: 52878 - DNA, 101 bp, rice(Oryza sativa)
  misc_feature (71): n=a or g
ccattcggattttaggaaagcaaacgggttcatacaatattgtcttgacgagcccaataagccgtagcacnaatgttggaataaatcggatggccgcaaat

SEQ ID NO: 52879 - DNA, 101 bp, rice(Oryza sativa)
  misc_feature (71): n=t or c
ctctgcctctccaagcctctaaacaaccgaacagcctcatcctccttccccaatttcacgagtgcctcgangacaacggtgaacgtctccggggacatcct

SEQ ID NO: 52880 - DNA, 101 bp, rice(Oryza sativa)
  misc_feature (71): n=t or c
agaggaggtggtctctagaaccagctaggtttttgtatctcatggcttgagctcaccagattaaggtaganagggggaccatgagaaggtggtgatgatgt

SEQ ID NO: 52881 - DNA, 101 bp, rice(Oryza sativa)
  misc_feature (71): n=a or g
acttgctaggttctaactataagttatagatatatgattaactacgtggaaggtttttctcttcttgaccncaatttttgagggtttagggtttagaggca

SEQ ID NO: 52882 - DNA, 101 bp, rice(Oryza sativa)
  misc_feature (71): n=t or g
acaaatccttaggctacaatttgatgaaaaaccctaccttggaggggataaaacaagtgttggaccttagntacaataatctttctgagcatttgaagcca

SEQ ID NO: 52883 - DNA, 101 bp, rice(Oryza sativa)
  misc_feature (71): n=t or c
aacagcaaccggtaccaaccgggacaaaaagattgattatttcaaccgagactagtcctggattgctactnccggttgaaaaaccgagactaaaaggggtt

SEQ ID NO: 52884 - DNA, 101 bp, rice(Oryza sativa)
  misc_feature (71): n=a or g
cggtaattggaaatataaaagagatgggagacaagaattttttttacaaattcggagcccttatctgatangtaataactctactcctattgaccgaaact

SEQ ID NO: 52885 - DNA, 101 bp, rice(Oryza sativa)
  misc_feature (71): n=t or c
gatttttttcatatcctagacaaaagccactatgacataccatcaacatcgtctaatacagtgatatcaangactctgaatttctacctcttgttatacgt

SEQ ID NO: 52886 - DNA, 101 bp, rice(Oryza sativa)
  misc_feature (71): n=t or c
ctaattttgtgggtaatgctggttctttgagttactaaattagagcaagtagtatagttcactactagttncaaatcatctatagccaatgtaataatcaa

SEQ ID NO: 52887 - DNA, 101 bp, rice(Oryza sativa)
  misc_feature (71): n=t or c
caatgcaggagaagaaaatgcactggtactatgttggatcaccccgttgtgtaacatttcttgaacttgcntttcaatttcatccttctgcccaagagtat

SEQ ID NO: 52888 - DNA, 101 bp, rice(Oryza sativa)
  misc_feature (71): n=a or g
taaaaaaaaaatccgtatagtttaacagtttgggaatttcataatgtgaaagcttttctcatagtttgtcnaaatcgatgatcaaagatacaagtttaatt

SEQ ID NO: 52889 - DNA, 101 bp, rice(Oryza sativa)
  misc_feature (71): n=t or c
tgcatcttgtgctgtgctgcatgattccttgaggattaattttggacatttcattggcccctcagccttcncatggggcgcccagtgtctcatgtcaaggt

SEQ ID NO: 52890 - DNA, 101 bp, rice(Oryza sativa)
  misc_feature (71): n=t or g
cgtctccgagtgcgggaccgatcacatgctgaaggagtgcaccgacgagctgatcaactgggtcgacatgngagtggcaccggacggccgctccggcgtgg

SEQ ID NO: 52891 - DNA, 101 bp, rice(Oryza sativa)
  misc_feature (71): n=a or g
atataaacgcaataaatttggtagaacatgaagagagccttcaactacaattcatcagttgcccgtctacntcgaaccacgtagagaccaggtttatccta

SEQ ID NO: 52892 - DNA, 101 bp, rice(Oryza sativa)
  misc_feature (71): n=t or g
gagctagggaaggcatctctgcaaggataagaatgtcatccttcaaaagcttccctaaagaaagttccaanctgtgtagcacattgagttcgcctatccag

SEQ ID NO: 52893 - DNA, 101 bp, rice(Oryza sativa)
  misc_feature (71): n=t or c
atggaatgacaatactttgtcgtctagcgttatcagctgatcagaaggctcatcaataaccgaaggatcancagaatcatcgagaaccccgattcttaata

SEQ ID NO: 52894 - DNA, 101 bp, rice(Oryza sativa)
  misc_feature (71): n=t or c
cctcttgcactgcacgtgcttgctcctcatctttgtgcgctgcatgtatctgttcctcgtccttgtgcgcngtccgcatcggctcctcctgctgctgcacc

SEQ ID NO: 52895 - DNA, 101 bp, rice(Oryza sativa)
  misc_feature (71): n=a or g
tcctcctcttcagcctcatcatgatcaacaccatcctgatgtgccctccctccatcctgaattctcagctngattggtggcaaaatctgtgttgttctcaa

SEQ ID NO: 52896 - DNA, 101 bp, rice(Oryza sativa)
  misc_feature (71): n=a or g
aacaacttcaacatgctagtagataatgccgtaagggcaattgtgaaagatctcgaatccacagacagcangagcttagtccaaagctccaagaagattta

SEQ ID NO: 52897 - DNA, 101 bp, rice(Oryza sativa)
  misc_feature (71): n=a or g
caacaaaattgggcagcaccataatttactacttaaaaatccatttgcaaggccccccgcgtcgctccctngggcaggggtgacacgggcggtgactcctg

SEQ ID NO: 52898 - DNA, 101 bp, rice(Oryza sativa)
  misc_feature (71): n=a or g
ttttggcctccgttaggtctataattaatccagacacaaccgagctgcactgtttagcgtggtggagggcngttgcgcggcactgatgcgcgggactgtgc

SEQ ID NO: 52899 - DNA, 101 bp, rice(Oryza sativa)
  misc_feature (71): n=t or c
ccctacatagttgtttgcagtcgtgcagatgtacaggcgatggacacttctcgctatctacagtagtaccnaagacatgtaaatgtgatgcacttttcaaa

SEQ ID NO: 52900 - DNA, 101 bp, rice(Oryza sativa)
  misc_feature (71): n=t or g
gtatgcaaatgcatatttagtttgttgattatttgattatttcttcaacttgttttggaaggtctccttanatgtacgggacgtcttactgtgacatattt

SEQ ID NO: 52901 - DNA, 101 bp, rice(Oryza sativa)
  misc_feature (71): n=t or g
gttggcgcgtacgcacacaacagcaaatccgtattatttcttgcaccaggatcctgataaaagatgtaggnatacaagtggatcacccgcgaagctttata

SEQ ID NO: 52902 - DNA, 101 bp, rice(Oryza sativa)
  misc_feature (71): n=a or g
ttacatgggaagaactgaccagcaaaaagaaaaggcgtactagttattattcaaccactggggtgtgtgtnatactaggcttcagtgttctatgcagctgc

SEQ ID NO: 52903 - DNA, 101 bp, rice(Oryza sativa)
  misc_feature (71): n=t or c
aaaaaattgtgattgattgataacaatttaaggctcgaacgcgaggtttttgtgctactcgatgcatcggntgattcgagccgatacattgagctggtttt

SEQ ID NO: 52904 - DNA, 101 bp, rice(Oryza sativa)
  misc_feature (71): n=a or g
ccagtggcccctgcctccccaccgttggatctaaaggtctagggataagggacattacacgtgggccttanagccatcggcatcacacgcaataggttaac

SEQ ID NO: 52905 - DNA, 101 bp, rice(Oryza sativa)
  misc_feature (71): n=a or g
ggcatccacactatggatgaaaaatgggtagtaagaccccttactaactactttatcattgtggaggtggntagtagaggaggtagtaactatagcagata

SEQ ID NO: 52906 - DNA, 101 bp, rice(Oryza sativa)
  misc_feature (71): n=t or g
atttttctacaaggacccgtctggtttctgatttaggttttgagtccactcacattttctccagtcctagntattccatgagagaaatagatctccctccg

SEQ ID NO: 52907 - DNA, 101 bp, rice(Oryza sativa)
  misc_feature (71): n=t or c
cagaattcactacatactcggtttactctcaagaaaattctagcaaaatgtgctttcagatttctctttantgctagcatgccaacattctcatcgtcttc

SEQ ID NO: 52908 - DNA, 101 bp, rice(Oryza sativa)
  misc_feature (71): n=t or c
caagcataccaccattgacttgaccacagattgagatgcatagcttagattttaatattatataacacaantattttttgaaactttgatcagaaatattt

SEQ ID NO: 52909 - DNA, 101 bp, rice(Oryza sativa)
  misc_feature (71): n=a or g
tgatgccagtgatcttgacaatcttgttattgttaccatcaccaaccgagatttcctcaaccagatgtgcntgaccaagcttgtcctcgcggagatgttcg

SEQ ID NO: 52910 - DNA, 101 bp, rice(Oryza sativa)
  misc_feature (71): n=t or c
atttggcttgaaaaaatgtgtcctccggataatatttgcagcatgtggtacagggattaatctgaagctancaacctctccatctgcaagagttggtagaa

SEQ ID NO: 52911 - DNA, 101 bp, rice(Oryza sativa)
  misc_feature (71): n=a or g
cgactccgacaaagataagttcaccatgaggtttggcaccgctacacgtggcaatacaggagtgactaacntggcaccggttgtagcctccaacaggaaca

SEQ ID NO: 52912 - DNA, 101 bp, rice(Oryza sativa)
  misc_feature (71): n=a or c
tccccccccccccaatactagctaatcgggtgtccaagtcagtctgtgggcaatatttatttttattgaanatattgagcactaaaagacgaatgagaggt

SEQ ID NO: 52913 - DNA, 101 bp, rice(Oryza sativa)
  misc_feature (71): n=t or c
ccacaggacatcgaaagaacattgcaaccccaaccttgctgatgtcatgagtcaagactgcgaccaccgtncctgcacctgtgccacaaaagtaccgcggt

SEQ ID NO: 52914 - DNA, 101 bp, rice(Oryza sativa)
  misc_feature (71): n=t or c
gctggctgcagccgttttttcttttattttgggggtcagaaaagccgtggcgcgcggcaaaaggccaagcnggtgcgacgagctcgcgcatgatcgcatgc

SEQ ID NO: 52915 - DNA, 101 bp, rice(Oryza sativa)
  misc_feature (71): n=t or c
ccacatgatcactttaagtcctaacccagagttgaaatttaaggtggaccacatgcacactccacagtagnctgtcaagtttgtgatgcttactgattctg

SEQ ID NO: 52916 - DNA, 101 bp, rice(Oryza sativa)
  misc_feature (71): n=t or g
gagctttggacagagattatcatcgatcaagcccttaattaataaagtagaaaatatcaacgatgcttatnaattgctaattttgaatttattaaattaat

SEQ ID NO: 52917 - DNA, 101 bp, rice(Oryza sativa)
  misc_feature (71): n=a or c
aatggacaagatcttaggttttccaagtcaatcaacttggcgacattcgacggcatcgtcgatgataagtnggctgtgtttagatccaaactttcaacttt

SEQ ID NO: 52918 - DNA, 101 bp, rice(Oryza sativa)
  misc_feature (71): n=a or g
gtttttatactaaatcgaacgtgtggtgaatctagtgcatggtttgagggcagattagaagcaagggctcncagagccatcgtttctcttattctgcgaca

SEQ ID NO: 52919 - DNA, 101 bp, rice(Oryza sativa)
  misc_feature (71): n=a or g
gacaggatatgtatggcgggagaaatctaatctctagttcgtgtagtcggaaaaggaaatgagagggaatnagaaatctaatcctttttcacaccgctact

SEQ ID NO: 52920 - DNA, 101 bp, rice(Oryza sativa)
  misc_feature (71): n=t or g
aatttttttctcttcctttttgggtggttctaaccattattctgaaaagcgacatgatagagtggtggccnacaaaaagttacatgtggtatgtagcgtta

SEQ ID NO: 52921 - DNA, 101 bp, rice(Oryza sativa)
  misc_feature (71): n=a or g
gccggcgatcgtctcctcggagtggtagaaatggcgtttcttgatggctgatttgtcacctggaaatgaancaaattaaatcacggtttcaacgtcagcag

SEQ ID NO: 52922 - DNA, 101 bp, rice(Oryza sativa)
  misc_feature (71): n=t or c
cttggaaataaaaatccttgagctcgagtgttcgatcgacaatttgcaatccactgacatatgagccctanaatcattttaattatttattttgaattttt

SEQ ID NO: 52923 - DNA, 101 bp, rice(Oryza sativa)
  misc_feature (71): n=t or g
taaaattttaagtgcaaaatagttatatttacgtagtttgaaactattcctccttcgacttcgaaacgatnatttatgtacttttcacagtaacaattaaa

SEQ ID NO: 52924 - DNA, 101 bp, rice(Oryza sativa)
  misc_feature (71): n=a or g
cacctcctcgtagacgacgacgatgaagaggaggtagcagatggagacgtcgacgatggagaagaacaccngcggagacctgacgacgtttttccagaggc

SEQ ID NO: 52925 - DNA, 101 bp, rice(Oryza sativa)
  misc_feature (71): n=a or g
ccatgatttcacaatcatgtgtcaaactcacaatggatcaggactagatatgatttgtgactgagcgtgcnaatcttgggaaaactacgtttccgtccaaa

SEQ ID NO: 52926 - DNA, 101 bp, rice(Oryza sativa)
  misc_feature (71): n=t or c
agtgccaagcgtccagcagctgtgaaatgctttggattcccttttgccaacttcttgtacatgtgatcaancagtttgctaaaatagaggtagacctcggt

SEQ ID NO: 52927 - DNA, 101 bp, rice(Oryza sativa)
  misc_feature (71): n=t or c
cactgacgagtggagctcagcaacataatatgtcaacagatagttcccctgtgtgaacccatatccatccncagcatcttcgaagagaacaccttcagctt

SEQ ID NO: 52928 - DNA, 101 bp, rice(Oryza sativa)
  misc_feature (71): n=a or g
gatggatcgatcaagaagatacaacgatcagtctacttcattagtgaagtccttagtgagtcgaagacgcnatacacgcagattcagaaactacgccacgc

SEQ ID NO: 52929 - DNA, 101 bp, rice(Oryza sativa)
  misc_feature (71): n=t or c
gtcatcttctttatattcattccattcctcccaaagacgcaacgtgcacacaccaccaccaccttcatctnggtggcttcgttcactccgcctacctacct

SEQ ID NO: 52930 - DNA, 101 bp, rice(Oryza sativa)
  misc_feature (71): n=t or c
aagaaagtggatttgattcagtggtggcagaaggctctgtaggatgcagcgatgcaatggatgtgaaaaanagtaatgggagcagcagctagaaatgaaaa

SEQ ID NO: 52931 - DNA, 101 bp, rice(Oryza sativa)
  misc_feature (71): n=t or c
gttttcagaatcgtatggcggattttcctgagaaagcagttgacggcgttttcacagtctgaaggcggagnttttgggacgatgagcaaacagaaaatgaa

SEQ ID NO: 52932 - DNA, 101 bp, rice(Oryza sativa)
  misc_feature (71): n=t or c
agatgaagatggtggtggcaagttcgagaccaccaagaacaggagtgggctagaggctgctgatctagtgntttttttcacaccccattagagttgttagt

SEQ ID NO: 52933 - DNA, 101 bp, rice(Oryza sativa)
  misc_feature (71): n=a or g
ggcaagaggaggtgatcaaagccaacttggatgtctctgacttataacacttagatgtgcgccaaccgaangcagctaagagtcaattcgagggctcctgc

SEQ ID NO: 52934 - DNA, 101 bp, rice(Oryza sativa)
  misc_feature (71): n=a or g
caacgccgggtacgtctcgagcaaactctccatggccaggagcttcagcctcacgcccttgaagatatcgncgtcgtccacgcccaccatgagtacgcggc

SEQ ID NO: 52935 - DNA, 101 bp, rice(Oryza sativa)
  misc_feature (71): n=t or c
ccgtgcatgtacgcattatggtctcatctctcttttctaatgctccctctataacattcgctgcaggaggnggtggtggtacgaaagggcgcaagagttgg

SEQ ID NO: 52936 - DNA, 101 bp, rice(Oryza sativa)
  misc_feature (71): n=a or g
aagcaatggcatttatacctcttcgtgctcggctatttttgaattcccttgttgattgtaaaacagctggngcaattctaggagatggttcatgtgcttca

SEQ ID NO: 52937 - DNA, 101 bp, rice(Oryza sativa)
  misc_feature (71): n=a or g
ttttgggttcaaattaaatgagtctagtttgtgcagctaactgaaatatatgcgttaattcctcccttttntgttcctttagatgccgctccatccgccgg

SEQ ID NO: 52938 - DNA, 101 bp, rice(Oryza sativa)
  misc_feature (71): n=t or c
gtcgtgtaatgtccttttaaccttagttcgcacgcgcaagataagtttatgtaacaaaacaagcattttanaagatcatacactagattacacccactcga

SEQ ID NO: 52939 - DNA, 101 bp, rice(Oryza sativa)
  misc_feature (71): n=t or g
caggagagctagctaattacagaatcaaggtgttctagctggcattcgcctgatcctccgttttcctagtnaaggtaacaccctgatccctcactggagtc

SEQ ID NO: 52940 - DNA, 101 bp, rice(Oryza sativa)
  misc_feature (71): n=t or c
tgcttcttctcactgtgtacacatgttgcaggcaacgatttcttcaagcagaaaaggtaccaggaagcagnaatgcactatactgaagccatgaaaaagaa

SEQ ID NO: 52941 - DNA, 101 bp, rice(Oryza sativa)
  misc_feature (71): n=t or c
gagcaagtggacagatagtcacagactcacaacctcacttcatgttatgttgcttatcaagtactccctcngtccgtgaatataagggatttagatatttt

SEQ ID NO: 52942 - DNA, 101 bp, rice(Oryza sativa)
  misc_feature (71): n=a or g
cagctgttgtgcattgccttctgaacatctacaaagaaacatggaaacactgggatctttacttggggcantcagcaatctgaaaacactctctatagttt

SEQ ID NO: 52943 - DNA, 101 bp, rice(Oryza sativa)
  misc_feature (71): n=a or g
aggacttattaaaatgtggtgtaatattatagattatggggctcagatgttactagtagggatggtgtgcnaatgaacaccaccaataccaatattttaag

SEQ ID NO: 52944 - DNA, 101 bp, rice(Oryza sativa)
  misc_feature (71): n=t or c
cggactaatgcggattttggaggcatggtgttacagttggtatcagagcataaacctccgctgtatgatgnatgtgctttgggccatggtctgcaccggag

SEQ ID NO: 52945 - DNA, 101 bp, rice(Oryza sativa)
  misc_feature (71): n=a or g
cacatgtcaaaagtgctaactagctatctccatgcaaagcactagatagtgacttacgtataagtttccancgcagaaatttcatacaaaaggattaccca

SEQ ID NO: 52946 - DNA, 101 bp, rice(Oryza sativa)
  misc_feature (71): n=t or c
tgcatttgttgatagaactgctcccgccacgcacatgacatcgttaatctggccagcacccgcagtgtctnagtactccctccgtttcaaaatgtttatca

SEQ ID NO: 52947 - DNA, 101 bp, rice(Oryza sativa)
  misc_feature (71): n=t or c
gactggttttcaagactctcgtaaggaacttaatcacattttttgtgggcccctggcttacgagtccaagngaaagcaaaagctgactgaacgagagatca

SEQ ID NO: 52948 - DNA, 101 bp, rice(Oryza sativa)
  misc_feature (71): n=a or g
tccggagtggtcttcaccgacctttcccgggtcagggccgttggttgaagaagagccatgaaaggatagcncaggagcctagagtaacctaagggttggca

SEQ ID NO: 52949 - DNA, 101 bp, rice(Oryza sativa)
  misc_feature (71): n=a or g
tatcaatcgatgatatcgtgacgttgataataccgagtcagaggttcaggactttgaataataggaacganaaaaaaaagaataaaagaaacataagattt

SEQ ID NO: 52950 - DNA, 101 bp, rice(Oryza sativa)
  misc_feature (71): n=t or c
tacatgaaagacctgtttggcaggacttcagcactaactgcatcaagagctgtagctcaatcaaatagttnagcttcacctaaaaaaaatgaagtggatta

SEQ ID NO: 52951 - DNA, 101 bp, rice(Oryza sativa)
  misc_feature (71): n=t or c
tgctgagaagctagctagctagtgagaatttggagaagctgggaaacccagttcaggcttctagttcattnttcagattctacaactacatattctcagaa

SEQ ID NO: 52952 - DNA, 101 bp, rice(Oryza sativa)
  misc_feature (71): n=t or g
cataaaggagaggatgtataaaattttctcatccggtatcgtggttgacttctcacatctgctcccggtcntgccatacaacgccttcaatccacctccag

SEQ ID NO: 52953 - DNA, 101 bp, rice(Oryza sativa)
  misc_feature (71): n=t or g
aatatcaatttttgcatctggacaaacgatccgcattcacccaaaatctgaaaatcggatctttgcaattnacatgcgaaaatccgattttcaaaataatg

SEQ ID NO: 52954 - DNA, 101 bp, rice(Oryza sativa)
  misc_feature (71): n=t or c
tatccaccggcccagttggcaaccctagattggtggtgttccggttgtatccccctttgcagccgacgatnccctcccctccaccgactcctccgccgtct

SEQ ID NO: 52955 - DNA, 101 bp, rice(Oryza sativa)
  misc_feature (71): n=a or g
tattggtggctggatatgttttatctccatgaatatgggtataggtcctgtaacttctagggagcacacanccttcttgctaatgtggtcagaaaaatttc

SEQ ID NO: 52956 - DNA, 101 bp, rice(Oryza sativa)
  misc_feature (71): n=a or g
gttttttttctaaagagaacacctcaatatatagaggattgttaaactcaattgaagctttggtctgcacncatggcacatgcctaacatatatagaggat

SEQ ID NO: 52957 - DNA, 101 bp, rice(Oryza sativa)
  misc_feature (71): n=a or g
ttacaactacttagggaatgtttggttaatgggttataggatctatcttgattttcggtggtacaacacanggtctaccttttcgattccgaagtaaaaac

SEQ ID NO: 52958 - DNA, 101 bp, rice(Oryza sativa)
  misc_feature (71): n=t or c
atgttgacatcagttgatcacatctttgcaaccaagaatcaggcccatacaatcaagcaatgcatcagtanattaataaatctatatacaccatctcactt

SEQ ID NO: 52959 - DNA, 101 bp, rice(Oryza sativa)
  misc_feature (71): n=t or c
ttgactcttaattaatgagttgatgatgttgactaaattaaggtgactatcacctccactataaaacttgncctgagaaagcgaccgcaccgtatgaacgg

SEQ ID NO: 52960 - DNA, 101 bp, rice(Oryza sativa)
  misc_feature (71): n=a or g
atgacctaatgctaggtgctctaacttggtcaaattactggggtccaattgtaagccagagaacttgttgnttccaatgtatattaattcaatattattta

SEQ ID NO: 52961 - DNA, 101 bp, rice(Oryza sativa)
  misc_feature (71): n=t or c
ccatccgattattggctcattaactcagtacagtttgaagcatgtttccgttggattcacagcgatccatnggcaaggccgaattcacaggccttcccctg

SEQ ID NO: 52962 - DNA, 101 bp, rice(Oryza sativa)
  misc_feature (71): n=t or c
tgcatcaacatggggtgtttgatgggccggaagatgttttccgttccaggcccactgatgactgaacattntggggggtctgtctttggatcagcttctcc

SEQ ID NO: 52963 - DNA, 101 bp, rice(Oryza sativa)
  misc_feature (71): n=a or g
ttaacagtttagggagttaaatgagtagaaattatttagggggcaaagtggactatctgagtagtttgagncaggaaagtggacttttttctaaagtatat

SEQ ID NO: 52964 - DNA, 101 bp, rice(Oryza sativa)
  misc_feature (71): n=a or g
tttttaggcccgctattgccctactcttttgccgcccccttggcttgacctctggctactccttttcctcnttatttagaaatgctcacgtatgtgttgat

SEQ ID NO: 52965 - DNA, 101 bp, rice(Oryza sativa)
  misc_feature (71): n=t or c
tttttttttctttttaagggttttttaatgaagttttgtagtatttctgttttttctttactccttcgagntggatcgcgtccctggattctcgaatcctt

SEQ ID NO: 52966 - DNA, 101 bp, rice(Oryza sativa)
  misc_feature (71): n=t or c
gactttcacatgcacgatgaagcgccttatataaggcaactaagatgatttgttaaggtgatcacggtcgntatagcgctatcgctttgccacctatcaaa

SEQ ID NO: 52967 - DNA, 101 bp, rice(Oryza sativa)
  misc_feature (71): n=a or c
ctcgatcgaaccggtgttccacaagcgtttgatcgattttgtgttaatttgatcgtacgtgcctgcagggngatcaagcagaacgtgaaggggttcccgcg

SEQ ID NO: 52968 - DNA, 101 bp, rice(Oryza sativa)
  misc_feature (71): n=a or g
cttgtcaatatcaccctcaattatcctccaatcgagttgagcgacttgggaaacttcgtcaccttcctctngcttatttttcagtaagtaggggaaccttg

SEQ ID NO: 52969 - DNA, 101 bp, rice(Oryza sativa)
  misc_feature (71): n=t or c
tccagcaccggacagctcgagaaatcaaggaaactgtgcatcagcttcacaccagtaagctgtagcttctncaaatgccgggagacgatggccaggttatc

SEQ ID NO: 52970 - DNA, 101 bp, rice(Oryza sativa)
  misc_feature (71): n=t or g
gaacaagatgctgacaagggagttggacgagcttcgaacagtagcaagggggaaaaggaaagaggaaaaanatggggagtgaggaaagaggaaaaaggaaa

SEQ ID NO: 52971 - DNA, 101 bp, rice(Oryza sativa)
  misc_feature (71): n=t or c
agggttaaaatcacgcatcccttaccacgtactgcatctcttgtttaagcatacacgtgaaagaaaatgtncaatcattttctttttgtttaagcatacac

SEQ ID NO: 52972 - DNA, 101 bp, rice(Oryza sativa)
  misc_feature (71): n=a or c
tcggtggcggtcggcgacaagacttcctgaaggtcttgggagatggagtcgtacagctatctgaggacgangcaatccatctgcacccactcggctaggtc

SEQ ID NO: 52973 - DNA, 101 bp, rice(Oryza sativa)
  misc_feature (71): n=t or c
agtacatatatatgtactcttatatagctgaaacccacttaacgtatttatactgttcatcacaagaagcnacacatctcatgacttatctttgacatagg

SEQ ID NO: 52974 - DNA, 101 bp, rice(Oryza sativa)
  misc_feature (71): n=a or g
aacctgaatcgaacacgccggagttctctgataccaccaggcaaagcccggatggtaatatatacaccagnctcgtcttcctcgacccactcccgctcttg

SEQ ID NO: 52975 - DNA, 101 bp, rice(Oryza sativa)
  misc_feature (71): n=a or g
gtcatctataattttttaaataggtaaagatgaaggaggaagtcatcacccttaaagtccacttgtaagtnggataagtccatttgagctccctctaattc

SEQ ID NO: 52976 - DNA, 101 bp, rice(Oryza sativa)
  misc_feature (71): n=t or c
aatgtttgccaagtgtcggaagacggtgaacagggcccaggttcagtacatttggcgtgtctgtcggaagnagttcaacatgtgggcgtggtttgagtcgc

SEQ ID NO: 52977 - DNA, 101 bp, rice(Oryza sativa)
  misc_feature (71): n=a or g
gacagagagcgaagccagaggtgatggcttggcgatgagctcgacggaaggaacgatgatgggcacggcanagggcacctttctatccatggccgtctcgc

SEQ ID NO: 52978 - DNA, 101 bp, rice(Oryza sativa)
  misc_feature (71): n=t or c
tcactggcctctccttgccaagtctccatatagccagaccaatcccagcctccgtttgtagcctcaagaanctgacctacatagacctctcttgcaacaat

SEQ ID NO: 52979 - DNA, 101 bp, rice(Oryza sativa)
  misc_feature (71): n=a or g
ccaggaaatttaaaggattttcctttttgcacaattccgataaaaatcctcaaattccgagcattccagcnaagcccttatcgtctattgatgcacatgcc

SEQ ID NO: 52980 - DNA, 101 bp, rice(Oryza sativa)
  misc_feature (71): n=t or c
gatagttttgtcatgtcacggtgacatagcaggacaatattgtcacgccagctaggggtgaaagcggtcanggaaattaccgatcgaccggatgtcgtttt

SEQ ID NO: 52981 - DNA, 101 bp, rice(Oryza sativa)
  misc_feature (71): n=a or g
ttcggaaaatcactaaagaatgctctacaccacgtatttggtgggatttcttctaggtactcatgtgcttncacgtttaaagctttcattttctccatgtt

SEQ ID NO: 52982 - DNA, 101 bp, rice(Oryza sativa)
  misc_feature (71): n=t or c
tagcatcaatttagcaaacaaaatgggtccaaattatgctaatacgtcagatcgagcctctagctgttggnctcttggttgattacttgaagctagtgatg

SEQ ID NO: 52983 - DNA, 101 bp, rice(Oryza sativa)
  misc_feature (71): n=a or g
gatgagaggaagattgaagtccggaatcacatcaccatggagagagagagcacgaagaactccttatatcncgctctcgaggatgataacgggagcacagg

SEQ ID NO: 52984 - DNA, 101 bp, rice(Oryza sativa)
  misc_feature (71): n=t or c
caattgtaattacctggagtatatagcagtgctctatgattggaatgttgcacaagcttaactgccacacntcctcccaaacttgatattaaccacagcca

SEQ ID NO: 52985 - DNA, 101 bp, rice(Oryza sativa)
  misc_feature (71): n=a or g
tcatgataagttttatgatgctgcccctgataactggactgcatgtgagtttgacgcccacatagtaagtngttcaaaaggggcggtgttaggaggtgttc

SEQ ID NO: 52986 - DNA, 101 bp, rice(Oryza sativa)
  misc_feature (71): n=a or g
tgcaggaagatgcctcgtttagttatattccccttcttccgactagatttggggaatttggctaaagaaangtgatgcttgtactctttgatccatgtgga

SEQ ID NO: 52987 - DNA, 101 bp, rice(Oryza sativa)
  misc_feature (71): n=a or c
atgtcaacatgcttcgtccggtcgtgatgcacaggattcttgacaagagaaattgtggactgattgtccancatcagttttggagcaggcgcatcagcctc

SEQ ID NO: 52988 - DNA, 101 bp, rice(Oryza sativa)
  misc_feature (71): n=t or c
gaccgaatcggacggccgagatcgatccggtctaccacggcaaaggcttataaggcgctgacatcagcgangatgtcatcgccggcggcgactcggcacac

SEQ ID NO: 52989 - DNA, 101 bp, rice(Oryza sativa)
  misc_feature (71): n=t or c
attgtagtaggacacaacatatctgtaggatcatcctttgagccattgcctcttagcaaaataccaggacngatcttatcacccatctccataatctgctt

SEQ ID NO: 52990 - DNA, 101 bp, rice(Oryza sativa)
  misc_feature (71): n=a or g
gaagtagtacctcatatagttgatctgaaatgattccaactccgtgagcataaggcactttcgactcgtantcgatgctttcgccggtacccgggttgcca

SEQ ID NO: 52991 - DNA, 101 bp, rice(Oryza sativa)
  misc_feature (71): n=t or c
gataaacctgcccgagctgaaagatccacctacttacctagcaaagcttctaaaatacgatggcgatgcgngatccaaaagattcttgcgtcaaatccgat

SEQ ID NO: 52992 - DNA, 101 bp, rice(Oryza sativa)
  misc_feature (71): n=t or g
ggatcaatcagacttccccacaggaaatgccaaggggcgccctttatcatcgcccatttcttccttgtctnctgctgccttaagtgcgtaaagtaggctca

SEQ ID NO: 52993 - DNA, 101 bp, rice(Oryza sativa)
  misc_feature (71): n=a or g
ttaggcggtcctcctacaagacaagggtaagtatatgttaagagatggaaccacatcaatgaataaagtgntcataaaatagaactgcaaggcatgggctg

SEQ ID NO: 52994 - DNA, 101 bp, rice(Oryza sativa)
  misc_feature (71): n=a or g
ccaaaccatgaaggcataatgggaacgatccaattactgaaaagagaccacaccatacttacttcgcagcntagagcttggttgctctgagcatgacccct

SEQ ID NO: 52995 - DNA, 101 bp, rice(Oryza sativa)
  misc_feature (71): n=a or g
ccctcaaaaggtgagttcaagcttgggtacgggacggtgaatggcgaagccattgcctgcatgtttggctnggccattgtgttcagctgaggtccggttcc

SEQ ID NO: 52996 - DNA, 101 bp, rice(Oryza sativa)
  misc_feature (71): n=t or c
cccaaaagtgctattcagcaactatctcaattcaactgttggatttgacaagatgagttactagttactantgtatgacagacaggctattaccagtaagc

SEQ ID NO: 52997 - DNA, 101 bp, rice(Oryza sativa)
  misc_feature (71): n=t or c
gccagagaatgcttgggagcaaattaagctaagtcatcaagcagtagtactccctacgtattttaatttangacaccgttgacttttttatcaccatttat

SEQ ID NO: 52998 - DNA, 101 bp, rice(Oryza sativa)
  misc_feature (71): n=t or c
tcagtgatgatagtgtcaataacaatctcatctagcagcatcttctcaatgcacaaagtagcctatcaganttggtaccatagtatacatattttggaggc

SEQ ID NO: 52999 - DNA, 101 bp, rice(Oryza sativa)
  misc_feature (71): n=t or g
tgaactaattgcttgatagaacagttcttagcgaacagcagctaaaacacgtggaacttgaaaagcggcanattttttccaagtaggacctattcaggctt

SEQ ID NO: 53000 - DNA, 101 bp, rice(Oryza sativa)
  misc_feature (71): n=t or c
atataatagttaactataaaaatatattacaaattaatactcggtcacatctctcattcacatataacgtnttggagtccgtgttgcagctggctataaat

SEQ ID NO: 53001 - DNA, 101 bp, rice(Oryza sativa)
  misc_feature (71): n=a or g
ggtgtactaacttcttgatttgtttgcagtctcccgttgttgctaagggtgcaaatactcttgcatggatnaaggtacaattgaacaattatgaactgcgg

SEQ ID NO: 53002 - DNA, 101 bp, rice(Oryza sativa)
  misc_feature (71): n=t or g
attggacgtaagccagatcctgtgcaatatgcattgaacctggtgggtgattaggagttcaaacaaattcnctaccatcggtcaggagagggttgttcagt

SEQ ID NO: 53003 - DNA, 101 bp, rice(Oryza sativa)
  misc_feature (71): n=t or c
acatgtatttacctttcttgtcataagattaaatcagacgaaatgtgtctacgtatgcatccgtatcaggnttatgatgttcgtaggcgtgtcacgtgcct

SEQ ID NO: 53004 - DNA, 101 bp, rice(Oryza sativa)
  misc_feature (71): n=t or c
tcttccatcttaggtatctgataacaaagagaaccaacagagtgagcctcactctgcaaggatgatccgcngccattaatggctgcttcaccttctctctt

SEQ ID NO: 53005 - DNA, 101 bp, rice(Oryza sativa)
  misc_feature (71): n=a or g
agctcgacaactgctagatccggtagctacaagcttgagggcggccagatctagccaagggtggggggcantggtcgtcacactagcaagaagcggcggtc

SEQ ID NO: 53006 - DNA, 101 bp, rice(Oryza sativa)
  misc_feature (71): n=t or c
tcacgacgcgggctccgtgccccccgatgaggatagacagaaccgtggaattcatcaccgccaccaccggnccataaccccctcctcattccagcgctgcc

SEQ ID NO: 53007 - DNA, 101 bp, rice(Oryza sativa)
  misc_feature (71): n=a or g
gcttctggttacgtggtctacatcatagcaaacaacagtggcttgacggggcatctcccacgggaaacacncaacctttcgatgttagctgccatctacct

SEQ ID NO: 53008 - DNA, 101 bp, rice(Oryza sativa)
  misc_feature (71): n=a or g
gatacgcacggtcacgagagtacggtttgttgcaacgtgggacctagtgcatcgtggcaacatggtgtctnttggtatttcttaacgacattactaaaaat

SEQ ID NO: 53009 - DNA, 101 bp, rice(Oryza sativa)
  misc_feature (71): n=a or g
tcgatggacaagggaaagtgtcaggtctcaggctctcagctcggtgcatgggagagaaaacgaacgacacngaggaaattttgtccagaaaaatattaaaa

SEQ ID NO: 53010 - DNA, 101 bp, rice(Oryza sativa)
  misc_feature (71): n=a or c
tgcttaattctatgatttctgaagctggtgaagctcttgatgaatatatccagactcattcagaggtacanatttttttgaggtcatagcataaatacccc

SEQ ID NO: 53011 - DNA, 101 bp, rice(Oryza sativa)
  misc_feature (71): n=t or c
atatactccattttctttcgtattacctactattcaagttttgttgcaagtcaaatatatgtactcttggntatcaagttttacaaatgagtatagtttaa

SEQ ID NO: 53012 - DNA, 101 bp, rice(Oryza sativa)
  misc_feature (71): n=a or g
ggacggtgatggatgaaatgtagccctatcgtggatggcaggggtggagatggtgaaattttaacaccgcntggacaaggacgtagatgtgtgaccccgac

SEQ ID NO: 53013 - DNA, 101 bp, rice(Oryza sativa)
  misc_feature (71): n=a or g
aacatttgtcataacaatgaaacgcaaacacccttgcaacaaaccttgccagcgtctatggctcttccaanagccagtagctgctcttccattggaacaga

SEQ ID NO: 53014 - DNA, 101 bp, rice(Oryza sativa)
  misc_feature (71): n=a or c
cattcagcaaccatagcttctgcctacacacacagaaaaaattcatatcagcataaaagtcataagggcanacttggtaatgtaacagatgaaggtacaaa

SEQ ID NO: 53015 - DNA, 101 bp, rice(Oryza sativa)
  misc_feature (71): n=t or c
ttgaacacaaacacaccaaaaacctaagaaatgaagtgtcaaaacaaaattagccttgaaccatcaggtcnatcccacaatttcttttatttctttgaagc

SEQ ID NO: 53016 - DNA, 101 bp, rice(Oryza sativa)
  misc_feature (71): n=t or c
agggttcggaaattctgcaaattgtagattggaaagatgaataacaagaaatggatccctaataatagcanaagtttatctgtttagatgataaaatattg

SEQ ID NO: 53017 - DNA, 101 bp, rice(Oryza sativa)
  misc_feature (71): n=t or c
tagttctttgcaagtttgtgtcaaccaaattgaagacagaaaatcaattatccctgcatctggcttgatgnagaagaaactaaaggaatacatatatgttg

SEQ ID NO: 53018 - DNA, 101 bp, rice(Oryza sativa)
  misc_feature (71): n=t or c
taggtgtagtggtggggatgaatgtgctggaaagttgtctgtttcgtgttagtttcatgatgaatttgtcngaactgataactgaattggctttacagatg

SEQ ID NO: 53019 - DNA, 101 bp, rice(Oryza sativa)
  misc_feature (71): n=a or g
cgtgtacagcataggtgactgaaatttcaggtcacagaatagccttgcaaaaaaatcagagaatcggtgcntctttcagagtcggttgtcctgtttctgta

SEQ ID NO: 53020 - DNA, 101 bp, rice(Oryza sativa)
  misc_feature (71): n=a or g
atgctcatctagagttcgggcttggcatggtgtttgaggttcagaacggtccaacgcaggagacatcgttnccgccaccaccatcggacttgccacagtgc

SEQ ID NO: 53021 - DNA, 101 bp, rice(Oryza sativa)
  misc_feature (71): n=a or g
atgactcaccatggatggcggcgttgatggcgacttccctaatgagcccttgaaactccgttaggtttcgnctgtgtttagttcaacatcaaaattgtaag

SEQ ID NO: 53022 - DNA, 101 bp, rice(Oryza sativa)
  misc_feature (71): n=t or c
acactcatccctatggatataagtaagcacatcatattcgtatgagcacatttgagagacttgactgatantaataaagtcaccatggacatattgttgtt

SEQ ID NO: 53023 - DNA, 101 bp, rice(Oryza sativa)
  misc_feature (71): n=t or c
actgaaagggatgagttaaaaatcatgtattcgagtcctggtacgtgtaagagttttttttttcctcatgncatgcacggttctagcgtagcgtaaatctc

SEQ ID NO: 53024 - DNA, 101 bp, rice(Oryza sativa)
  misc_feature (71): n=a or g
gatcgcattcttttcttcgatatgtgctgcactgtaaaatgtgtaataggcatggttgttttgtagggctnatgcccaggagagtaaaccagaagagtcaa

SEQ ID NO: 53025 - DNA, 101 bp, rice(Oryza sativa)
  misc_feature (71): n=a or g
gagtcggccctcgcccagtgcatctgcttcggctgcagctgcggcgtcattgctctctctcagactctcantccacgcctccacggtagctcagctcttga

SEQ ID NO: 53026 - DNA, 101 bp, rice(Oryza sativa)
  misc_feature (71): n=a or g
aatacaatatagcaccatgtatgtaagtgtgtatatgtatgcaccatttggcacacaatgttcctgtcaantgctacacaatcatgaatactttgtaacta

SEQ ID NO: 53027 - DNA, 101 bp, rice(Oryza sativa)
  misc_feature (71): n=t or g
agtacaaaggctttcatccctgtctagttgcatgcatgtaactaactgcatatatgtggccatggaaatangtggcatccgggcaagagcgattaggtgca

SEQ ID NO: 53028 - DNA, 101 bp, rice(Oryza sativa)
  misc_feature (71): n=t or c
ggttcaatggggtctgtccacaatttatcttggacagcgtcccaatcaatcagtacaagatggacctccantggtagaagaaaaggtgcgcgtaatgtgct

SEQ ID NO: 53029 - DNA, 101 bp, rice(Oryza sativa)
  misc_feature (71): n=t or c
tacattgtgaaacggaggaagtactaaatttactttctgatatactccctctgtctaaaaaagataaactntgtgtttccgtgtccaacgtttaaccgtcc

SEQ ID NO: 53030 - DNA, 101 bp, rice(Oryza sativa)
  misc_feature (71): n=t or c
aagctctaggtcccggtgcggagcccgcactcgtgctcctcttcaatgccttcgccgtcagcgtcctctcngtctaggcggcagaactcggcggcgacctc

SEQ ID NO: 53031 - DNA, 101 bp, rice(Oryza sativa)
  misc_feature (71): n=t or c
cggcctcctaggagagaagagctgaagagaagaaaaacaaaagagataagagagaagagaagtggtctccnactttttttaattttttttgctgactatga

SEQ ID NO: 53032 - DNA, 101 bp, rice(Oryza sativa)
  misc_feature (71): n=t or c
aacagcagtgcatcaaagcatggtgttgaacagagaagggaaagagattctgagccaatgttcttgtactntggacttggttcaggatttgtggctggtct

SEQ ID NO: 53033 - DNA, 101 bp, rice(Oryza sativa)
  misc_feature (71): n=t or c
aagttccaaaattgctctacatgaatgaacacatggcagcaagatgctctgctttgcacacaaaacgaagngacgaattaacatataattaattaagtgtt

SEQ ID NO: 53034 - DNA, 101 bp, rice(Oryza sativa)
  misc_feature (71): n=a or g
tggttattgtcgccttcaggcttctctgctcctataacatcaaaataggattcatccttactcgataactnggtgttcgccggtgagaccattatacggcg

SEQ ID NO: 53035 - DNA, 101 bp, rice(Oryza sativa)
  misc_feature (71): n=a or c
ggggggggtgtagaagtagcgaatttacaataaattcacaactgttgcaattcgctacttgcaaatgctcnatccgtgtccgactgctactcgaactcgat

SEQ ID NO: 53036 - DNA, 101 bp, rice(Oryza sativa)
  misc_feature (71): n=t or c
ttcatagatctgcatgctaacatcaagactggccgccgttgatagcatgacacatgatattataagggagntacttggtgtcaaattagacatgacaaact

SEQ ID NO: 53037 - DNA, 101 bp, rice(Oryza sativa)
  misc_feature (71): n=a or c
ttgagcctagtcggcagggcgaagccatagtagaccttccccttgtagaggacgctgtcggtgaaggcgangaagacgcaggcggcggagaggaagacgac

SEQ ID NO: 53038 - DNA, 101 bp, rice(Oryza sativa)
  misc_feature (71): n=t or c
atccgcaatcaagttcagatgcctcatgtcaacatggataccataagcaccgaatacgcccttcacttccncaatgatggttgcccttgcagcctctaccc

SEQ ID NO: 53039 - DNA, 101 bp, rice(Oryza sativa)
  misc_feature (71): n=a or g
gattaatatacgtgactggataagaaaaacaagcacagttagagaaaatttccagtccggtcagtaaaccntataagattctattgattgcttaaaccgta

SEQ ID NO: 53040 - DNA, 101 bp, rice(Oryza sativa)
  misc_feature (71): n=t or g
tttagactatgccatacctcactaggaggtacctgaacagggacaaaataataagcgtgagtggattcttnttaccattcagggcatacaaagacctagat

SEQ ID NO: 53041 - DNA, 101 bp, rice(Oryza sativa)
  misc_feature (71): n=a or g
atatatcccgcaacaaagcatagggcatcatctagtttatattaactcttctgtccacacgaacagcaacnaggagaggagcaaggggtgtactggtgccg

SEQ ID NO: 53042 - DNA, 101 bp, rice(Oryza sativa)
  misc_feature (71): n=t or g
gaaagatgtggaacggataaggcttctggtcaaaacaagaagaatagaaaagcctcctgggtatagctctnttgagttgaaaggtaaaatctatttgtttt

SEQ ID NO: 53043 - DNA, 101 bp, rice(Oryza sativa)
  misc_feature (71): n=a or g
gaaggacaagttcggcggccaagagctcgatctctcgggctccgtagtggtcatgacgacatcgaagctcnccgatgcagcggtcagcggcgtcatcagcc

SEQ ID NO: 53044 - DNA, 101 bp, rice(Oryza sativa)
  misc_feature (71): n=t or c
taaatttggctaatactgacatgttttgttggagttcagcatattaatcctacagaggcatttgggcgtgnaatgattgaatatccgtaagatgagataac

SEQ ID NO: 53045 - DNA, 101 bp, rice(Oryza sativa)
  misc_feature (71): n=a or c
atctgaagattaaattttgtgttttgaaatttaagctgcacaagtggtagggcagtttcactgtcaactcnggttactgatctgcaattaacttgtatatg

SEQ ID NO: 53046 - DNA, 101 bp, rice(Oryza sativa)
  misc_feature (71): n=t or c
agaaaattccctgcacatttctgcagcaatgagcaatcatcaggtaaaactgtaaaagtttgtgggggcancactgatcttgcttgatgtgagcttcacat

SEQ ID NO: 53047 - DNA, 101 bp, rice(Oryza sativa)
  misc_feature (71): n=a or g
tagtacacatcctgagcagcacgacctgcctcccctggcttggttaattttgcagtggtggcagcaaacancttcactgttgcttccagtatgcagcctcg

SEQ ID NO: 53048 - DNA, 101 bp, rice(Oryza sativa)
  misc_feature (71): n=t or c
ttgtttttactctaactaggtatggatgtgtggaatattgttgaagtccctacagtacgagctgactaganattgtaggtatatttgcgccgtgtatattc

SEQ ID NO: 53049 - DNA, 101 bp, rice(Oryza sativa)
  misc_feature (71): n=a or g
tagtagaaatacttatattttagaacataaaaagtacaacacacagtagaaatattgttcacatgccctcnagagatattactcgagcatgttttatactg

SEQ ID NO: 53050 - DNA, 101 bp, rice(Oryza sativa)
  misc_feature (71): n=a or g
ctacaccgattgaatctatgcagagtgccatttatataatcttcttctttgtgggttctgaattgtcctgnagtataagtgatgttccttctctgtagact

SEQ ID NO: 53051 - DNA, 101 bp, rice(Oryza sativa)
  misc_feature (71): n=a or g
ctttcaatcgaatgtatctcgccaaacaagatcaaagaagaatatgtgatgcaagcaaaacatgaacattntgcgcaattcgtatatggacatggcataat

SEQ ID NO: 53052 - DNA, 101 bp, rice(Oryza sativa)
  misc_feature (71): n=t or c
ttctcctctcttctcctttctttcctctctcatcttttggttcttctgtttgccacagaagaggggggagnggcagcgagcgaggacgagcgaccagagca

SEQ ID NO: 53053 - DNA, 101 bp, rice(Oryza sativa)
  misc_feature (71): n=a or g
ctaggtggagtagctgatttaatttcctctatattgctgcaagagatatcgcatggacagcttaggctccncccagggcgccgtcaactctctattgggcc

SEQ ID NO: 53054 - DNA, 101 bp, rice(Oryza sativa)
  misc_feature (71): n=a or g
tacagtacagattatcaatctaggaacatactcctaaaagattctgttggtatccaaagcactctaccganggaaaccgaaagcagggctgaaattacaaa

SEQ ID NO: 53055 - DNA, 101 bp, rice(Oryza sativa)
  misc_feature (71): n=t or c
taaaataattagacttaaaaatgtgtctcgagttttgcaagtagtctatgtttcatgctttaaattaatgnctaaatatctaatgtgacagggattattta

SEQ ID NO: 53056 - DNA, 101 bp, rice(Oryza sativa)
  misc_feature (71): n=a or g
tttattaaattgtataaaactctactattatgatctaaatagcacaaaaccacggagattttggcatgtgnaacataactcaagggattatggttttaaaa

SEQ ID NO: 53057 - DNA, 101 bp, rice(Oryza sativa)
  misc_feature (71): n=a or g
atcattttttatgggacggagggagtaactcgctaatgtagctgaacaggcagaaaacaacttctatttcntacttatccacatatatctagagttaacga

SEQ ID NO: 53058 - DNA, 101 bp, rice(Oryza sativa)
  misc_feature (71): n=a or g
agtaaagtgaagaaaatgtttttttccctaatcgacaatgaatcagtgcatgaacaattgagcgcgacttntatgttcatgaggagactattttgatcctc

SEQ ID NO: 53059 - DNA, 101 bp, rice(Oryza sativa)
  misc_feature (71): n=t or c
tctcactcaactctcgtgtggcaggtgcatgatctcgcttccaaaatcatacataggctcgcatggagacngttcacgccacacgtgcatcacagatgacg

SEQ ID NO: 53060 - DNA, 101 bp, rice(Oryza sativa)
  misc_feature (71): n=t or c
tgaagaatgcaacgccaagctggatctggaaaaacaaaaattagccaatcttcccaatgccgttgaagaanagaagtccagactaagatcggccataaaaa

SEQ ID NO: 53061 - DNA, 101 bp, rice(Oryza sativa)
  misc_feature (71): n=t or g
gaaacagttagcggtgttgatcgatccaatcaagtggggtgttcaaaggatattgtcaattgtagccaaanacttggctcggagcatgaagaactagctga

SEQ ID NO: 53062 - DNA, 101 bp, rice(Oryza sativa)
  misc_feature (71): n=a or g
catggaatttacctgacaaatctgagtacaactagctagcaaagcactataaaatgtgcccgcgtaatttngctcttcttctgatagaaattaatcaatag

SEQ ID NO: 53063 - DNA, 101 bp, rice(Oryza sativa)
  misc_feature (71): n=t or c
tttgctaaacaccatacagtggtaggtacccatatacatgtgcacactcaacactataaacatatatacgngtatatcctgccttaatatatgagcacctc

SEQ ID NO: 53064 - DNA, 101 bp, rice(Oryza sativa)
  misc_feature (71): n=a or g
cccatgtggttgtcttcttgaagcatgagatcgatgtctccttcgatgacctgaactgctgttgtgcttgntggtaccaccagtgctgtttgtctggttga

SEQ ID NO: 53065 - DNA, 101 bp, rice(Oryza sativa)
  misc_feature (71): n=t or g
cggcatgggttccacgcagcaatcttcctgtcggtgatgttggccgacagcacaatccttagcaaggtaangtttgtagggatggactggatctggcagca

SEQ ID NO: 53066 - DNA, 101 bp, rice(Oryza sativa)
  misc_feature (71): n=a or g
tgatgctgcttgtcaatggcgtaaggtcgctgcaattcaggagggacgacttacccgatgaccgtacgccntcttcccgtcatccgtcgccgaggagggga

SEQ ID NO: 53067 - DNA, 101 bp, rice(Oryza sativa)
  misc_feature (71): n=a or g
gctccccaccgaccctctaagagtgatgtggaaaatgcctgtctagctacttcccatccaaatcactactngaacctgtactacggcgaaataataaaacc

SEQ ID NO: 53068 - DNA, 101 bp, rice(Oryza sativa)
  misc_feature (71): n=t or c
gggcacatcacaggcggtactaatgaggaggacacaaatatgctggtttaactgacaccattgagatatanggtttgaaaaaaaaaagctggctcgactcg

SEQ ID NO: 53069 - DNA, 101 bp, rice(Oryza sativa)
  misc_feature (71): n=a or c
gcaaccttcacgagcaagcgtgtgttcgtcgtgcttgcataatgctctacttgtccacatcacactgcccngtcgttgctgccgtccttatcccccgtagg

SEQ ID NO: 53070 - DNA, 101 bp, rice(Oryza sativa)
  misc_feature (71): n=a or c
atgttttgtgtgctgatctagctagcgtttgtcatctatatagtggtagtactgataggagtattggtttntctagaagttcgtttcctttaccgtgcaaa

SEQ ID NO: 53071 - DNA, 101 bp, rice(Oryza sativa)
  misc_feature (71): n=a or c
acatggtgtgtgtatatacacctggcacatacagtaaacaatttctgcaatggagaaaaatagggagtacnagtaaaaagaaagtgttgtcccttcactgt

SEQ ID NO: 53072 - DNA, 101 bp, rice(Oryza sativa)
  misc_feature (71): n=t or c
acatgtttccaaagctttgagtttgttatcaaagcatcaacaatcgcagaccgtgaaccctcgggcacagnaggtagaatttgtctaaagtcaccgcctag

SEQ ID NO: 53073 - DNA, 101 bp, rice(Oryza sativa)
  misc_feature (71): n=a or c
aaaaataacactggaaatttctgaacttaccatctcaatactttcaggtctggaggctgtacgagagcgancgcgcccttgacatcgtagacccaaacctc

SEQ ID NO: 53074 - DNA, 101 bp, rice(Oryza sativa)
  misc_feature (71): n=t or c
gagattgggcgtgtccctttctggatctactggagcattttggtcgtcaagtgcatgtacaggattgtganacgccatcaagcatccaagaccttatggca

SEQ ID NO: 53075 - DNA, 101 bp, rice(Oryza sativa)
  misc_feature (71): n=t or c
cgtcggccaaaccaagctcacgaagcggtaaaatatggcctcctcctcttctttcgttccttctcttttantttcttctctccctctttctctccctgtcc

SEQ ID NO: 53076 - DNA, 101 bp, rice(Oryza sativa)
  misc_feature (71): n=a or g
ttatgctctaggtagaactcattgttcaagtcatctatcctcagatcttctggccattcaaaatcttcatnagcgtacgatattgttgtgtcacttgggaa

SEQ ID NO: 53077 - DNA, 101 bp, rice(Oryza sativa)
  misc_feature (71): n=t or c
ataacagacctgagtcagagtttgactgtgaaatccaagatttgttgcgttcaacattcctcaaaagcagngggagcacctcaacttggtctgttgtaacc

SEQ ID NO: 53078 - DNA, 101 bp, rice(Oryza sativa)
  misc_feature (71): n=a or g
aagtaaagcagtcgggggatctgaaaattgcaatgctcaaatcggagcctttgccgtcacctgaataactnatacgcatcgcagggtctttgccgtcacct

SEQ ID NO: 53079 - DNA, 101 bp, rice(Oryza sativa)
  misc_feature (71): n=a or g
gaaacgcaatgtgccagatctgttgctccaagaagtgtatgagtctatatgtgatggcactgggtttgctngtcctgtctgggatcacttgcttggttact

SEQ ID NO: 53080 - DNA, 101 bp, rice(Oryza sativa)
  misc_feature (71): n=a or c
tctcgacctttcccatggaataggtatgtactcaacagatatacagtggctcaccaatctaccagccctanggtacctaggcttatcaaatgtaaacctca

SEQ ID NO: 53081 - DNA, 101 bp, rice(Oryza sativa)
  misc_feature (71): n=t or c
aaaccattttcaaagacatgttaattttatttttatacacggtccaaagttcggccggtattaatgatgangaggttttgtgcgtacgcttttaaccggca

SEQ ID NO: 53082 - DNA, 101 bp, rice(Oryza sativa)
  misc_feature (71): n=a or g
tattgtattggctctaagaagcgatgaaatgagctaggagagagaagtagtgattgggtggtgctaccttnacgggtgtcatgatgtgatttggcatgtat

SEQ ID NO: 53083 - DNA, 101 bp, rice(Oryza sativa)
  misc_feature (71): n=a or g
ttcactccctatagttacaagtgtatttacagcagcataagttgtagcgagatgaggcaactagcacaaanaagtgaaattgacatcaaaaaattcgcctc

SEQ ID NO: 53084 - DNA, 101 bp, rice(Oryza sativa)
  misc_feature (71): n=a or g
gagtcatccatttggtgacattttcactcacgtaagagtggacattcctttagtatccgtaaattgcactngcccgtttttaggttttcaatgtgaattca

SEQ ID NO: 53085 - DNA, 101 bp, rice(Oryza sativa)
  misc_feature (71): n=a or c
aaggaaagtcaactttatgccattaagcttgcatcggttcaatgatatgtcattaatattgtatctttctnttatataccattgagtttagccataattct

SEQ ID NO: 53086 - DNA, 101 bp, rice(Oryza sativa)
  misc_feature (71): n=t or g
cgttctaagaaacggaaaccagtgacccatccctaattaatctaactgaaatcccgttgaaagccctcccncaaacacgtaatattcactttcacgcaccc

SEQ ID NO: 53087 - DNA, 101 bp, rice(Oryza sativa)
  misc_feature (71): n=t or c
aatcagctgagtaattaggattgatggagttgttttcaacaaagataacaccatgaaactgtaagggcagnagtagtgcggcacatataattcttgaacct

SEQ ID NO: 53088 - DNA, 101 bp, rice(Oryza sativa)
  misc_feature (71): n=t or c
catcaaggagccaatgaacctttctctgtctccttcacccatagccgaagatgtatccatgaatatccttntgagaatccttatggcgtgtttcttcagca

SEQ ID NO: 53089 - DNA, 101 bp, rice(Oryza sativa)
  misc_feature (71): n=t or c
gatctagtcaatatttcggctttgtgttgcactacttcattatttgcgctattcttgtcgttgtcgaaagngatgacttattgtagacaaagcaagtagac

SEQ ID NO: 53090 - DNA, 101 bp, rice(Oryza sativa)
  misc_feature (71): n=a or c
gggatgttgtctccatgtgttgtatacatgtaagaatagttcttcccaaactcttgcttgcaatttgcacnaatttccagtttatatacattgatgcttga

SEQ ID NO: 53091 - DNA, 101 bp, rice(Oryza sativa)
  misc_feature (71): n=t or c
cggatctcttagaacgaaaacagtggcatgaagggcgccgatcgatccatccatcgattcgatatatgagnatatattgccaggtcgtcgtcaccccctga

SEQ ID NO: 53092 - DNA, 101 bp, rice(Oryza sativa)
  misc_feature (71): n=a or g
gtctttgacagcttggtcgcaggcacttctccttcacttgccatagtcgtagtcagtcggatctcttcacnagcaagggtgatctcgcgggtttgggccat

SEQ ID NO: 53093 - DNA, 101 bp, rice(Oryza sativa)
  misc_feature (71): n=a or g
actgaacactcggtcatcgtcgtttgtttaagcatagaaaacaaatggttaattggttaatttgatccatnccattgaaaatatggctattcagaaaaata

SEQ ID NO: 53094 - DNA, 101 bp, rice(Oryza sativa)
  misc_feature (71): n=a or g
atgcttctagttgtatattgatgggaaggcaaacaatattgcttggagcaattttgccattaacaagtacnctgtattggaagagagaaatctccattcaa

SEQ ID NO: 53095 - DNA, 101 bp, rice(Oryza sativa)
  misc_feature (71): n=t or c
atcatctttatccccccccactccccctcgcacgtagcacacgctaaaaaaaaggaaaacatttgttgcangctaaaaaaatcgttagagaaaagaaatgg

SEQ ID NO: 53096 - DNA, 101 bp, rice(Oryza sativa)
  misc_feature (71): n=a or c
cttgtctcttgagccactgcattacctactttcttactcctagtaccccgcaatctccaaaatgccatgtncatctacaagcacatcactgcgccctccct

SEQ ID NO: 53097 - DNA, 101 bp, rice(Oryza sativa)
  misc_feature (71): n=t or c
aacatggacacacacacataggcaatctttttttttgtcatatttcgatctggcatctgcattatatctcnatttaagtcgtttaggacaatgtttaaatc

SEQ ID NO: 53098 - DNA, 101 bp, rice(Oryza sativa)
  misc_feature (71): n=t or c
aagtgggtcccacatgtaagtgacaaggagtaaaaaataaaaaacggtgggggtccatacttctccttttngaacagcgacgcgcgtagtagtgttgagta

SEQ ID NO: 53099 - DNA, 101 bp, rice(Oryza sativa)
  misc_feature (71): n=a or g
gatcccgttgggatactatcccaacgcgataccggtatataaagtgtcatgcatgtgtcgacttagaagtntttgtaggaagtttaatgggcttttactat

SEQ ID NO: 53100 - DNA, 101 bp, rice(Oryza sativa)
  misc_feature (71): n=a or g
agtgtaatgagtttcttacttcgacaaggcgacaattttattttactaggaacatgagcacactactgttnaaattaagctatatttaaatccatcatatc

SEQ ID NO: 53101 - DNA, 101 bp, rice(Oryza sativa)
  misc_feature (71): n=a or g
ccgggccgtacatgccgccgccgaagccgtccatcagcaagctaatcaaccaaacaaaatccgtcagtacngaattggagtcgggtcgtcgtcgccggcgg

SEQ ID NO: 53102 - DNA, 101 bp, rice(Oryza sativa)
  misc_feature (71): n=a or g
caaatgtcaaatgctccatgaccagagtactccagcatgcagtagtagaatatggagtacagatattaatnatgaggaggcacaagcacaacacaagaaga

SEQ ID NO: 53103 - DNA, 101 bp, rice(Oryza sativa)
  misc_feature (71): n=t or c
gaggagatgagtactgaaggaactccattgagcttggaaactgctgttagtgtaagtagctcagtcctttntgctccatccactccagccaacaatgactt

SEQ ID NO: 53104 - DNA, 101 bp, rice(Oryza sativa)
  misc_feature (71): n=t or c
cgtggcttggcttttggaaccactcgtgggtagtctgtaacttttacggaagcactttggttggaaagtgngagtgcttggcagtggttggagacagggca

SEQ ID NO: 53105 - DNA, 101 bp, rice(Oryza sativa)
  misc_feature (71): n=a or g
ccgcccgagacccgagaacatagcgggcagcatccgagtattgttttttacccgcagataacccatgcccnacctaatacatatgtatttgctaattttgg

SEQ ID NO: 53106 - DNA, 101 bp, rice(Oryza sativa)
  misc_feature (71): n=a or g
aagggttggagacttgcaggggaagagggaagagggaagaggagattagtactagtaactgttcattacantaataaagttcgccataataaggatttaag

SEQ ID NO: 53107 - DNA, 101 bp, rice(Oryza sativa)
  misc_feature (71): n=a or g
tgactatcttcatagctcattgttttcattgagtcttagaaaaatcataaattggcacacgaagagacagngacggatccagaaagaattaatatgagggt

SEQ ID NO: 53108 - DNA, 101 bp, rice(Oryza sativa)
  misc_feature (71): n=t or g
tatagttgattgcgttcttagattaatgaagtgcgcagatcataaatagtaagcacaaagtggccgatatngactcctctcgtttgtttaatttcatgaaa

SEQ ID NO: 53109 - DNA, 101 bp, rice(Oryza sativa)
  misc_feature (71): n=t or c
tgttaaatacagaaaagggaaaaattgaagagctattagttttgtctagattttttgttacctttggctcntttttagagcttcaatcctgcccctcagct

SEQ ID NO: 53110 - DNA, 101 bp, rice(Oryza sativa)
  misc_feature (71): n=a or c
aattttttagtgcgcacactttgcattgacacctgatgtgctgagtaggcagtttcagtgcttgctatatngtctaaaggcaaaatgcactgattctgata

SEQ ID NO: 53111 - DNA, 101 bp, rice(Oryza sativa)
  misc_feature (71): n=a or c
cagttgagctcatatgcatactttacagatgatgggcacaacaacgttttctactgactgtcagcctgacnactacgaaacggctgctccaggtcttgcag

SEQ ID NO: 53112 - DNA, 101 bp, rice(Oryza sativa)
  misc_feature (71): n=a or g
agcaaggaaagcaatctagttatttctgatcctgaatcattatctgtttggttatcatctattgatctctnggggatgttgctcaactactacccaactat

SEQ ID NO: 53113 - DNA, 101 bp, rice(Oryza sativa)
  misc_feature (71): n=a or g
catctatacatctgtgtacttagttccttgaccagctctggcttgacaagtggtgcgccgattgcgtatgngtgttttagatcttcttccatggctttctt

SEQ ID NO: 53114 - DNA, 101 bp, rice(Oryza sativa)
  misc_feature (71): n=a or g
aagcgcgcacacggattgccttgctctgataccatatgttataccccgcttgccgacgacgagaaattccnctgcgagccgccgggcacagtgtgaacgcg

SEQ ID NO: 53115 - DNA, 101 bp, rice(Oryza sativa)
  misc_feature (71): n=t or c
agaggaggggatataaggaggacgactctgcttttataatagtagagagactaagcttccttaggcgcgangtggccgaggcggatggcattgacatagtc

SEQ ID NO: 53116 - DNA, 101 bp, rice(Oryza sativa)
  misc_feature (71): n=t or c
tttatgaagttaataataataaataattcacgtaatcatgcgctagttgctcgttccatttttcgtgctcnattgttcagctttaatgggccaccaattta

SEQ ID NO: 53117 - DNA, 101 bp, rice(Oryza sativa)
  misc_feature (71): n=t or g
ttcaggtttcaggacataccagaagtaggactagcctctacatgaatttctgaagatcgagcagcaggtgnactagagctgactgtgtcctgaacatgggt

SEQ ID NO: 53118 - DNA, 101 bp, rice(Oryza sativa)
  misc_feature (71): n=t or g
aatggataacaaagtaaactaatcttttttattaaaggtaacctggcgagaaaaggccctaaagttctaanaaaaattgaaagaaaatgtcctaaagttat

SEQ ID NO: 53119 - DNA, 101 bp, rice(Oryza sativa)
  misc_feature (71): n=t or c
tcaaaaaaaaaagaggtacctgcttagtggtttttttttctcacatggcacaaatctcaagacgacccaanggatgagaaaaaaaatgcaatgttatatat

SEQ ID NO: 53120 - DNA, 101 bp, rice(Oryza sativa)
  misc_feature (71): n=t or g
ctctcgcggattcctaactagcgtagtagcttagcttcccatgtgttttttttcccaatcttttcttggtnagaatgcatacatggtcatggttgatgcac

SEQ ID NO: 53121 - DNA, 101 bp, rice(Oryza sativa)
  misc_feature (71): n=t or g
tcacctgaactgtggcgattcgtggacatgacacgccacaaggtgattttctcaaagggaacagacatacngtgtgcgatggcaaaagcggcaatagaccg

SEQ ID NO: 53122 - DNA, 101 bp, rice(Oryza sativa)
  misc_feature (71): n=t or c
gctgcaaattcagaaaaataaatgggcaatgcggagataaacatccacctctccgtgtcccaacttatccnctcatttctacacttaagtagagcatttag

SEQ ID NO: 53123 - DNA, 101 bp, rice(Oryza sativa)
  misc_feature (71): n=t or c
ttgattttgttcttaattctatgattgtgctcttggatgtctttggattgggaatctcatatgttgatttngttcttaattctaggattgttttcttggat

SEQ ID NO: 53124 - DNA, 101 bp, rice(Oryza sativa)
  misc_feature (71): n=a or g
ataaatttcagagaatccctgtctaaaagataaatcgatgaacaaatcctttccccaccagatttcctagngcttccaccagttgtacaaccagtatgaac

SEQ ID NO: 53125 - DNA, 101 bp, rice(Oryza sativa)
  misc_feature (71): n=t or c
cagtagaaatcactgtcaatactgccaggggacttgatgttcactggttttacaaaagttaggggatgctntgtattcggttttgcggttgaatgacgcaa

SEQ ID NO: 53126 - DNA, 101 bp, rice(Oryza sativa)
  misc_feature (71): n=a or g
ctcatcccacctgttccgcttctgcagattgacgtcaaacatcacttgagcgctcctaagggctttcacantgtagtgatgtggcattcagcctcaagctt

SEQ ID NO: 53127 - DNA, 101 bp, rice(Oryza sativa)
  misc_feature (71): n=a or g
catccaacatcacaaaccgctcaaactgccccttgagaatctccaccttgaactcgctaacactatccgtnacttcatgcaaactccgaagcgtgtcccaa

SEQ ID NO: 53128 - DNA, 101 bp, rice(Oryza sativa)
  misc_feature (71): n=a or g
aaaaaaaaaaagaacggaacgggggatatggaacaacgtgaaaggaaaagagaaaaacaaaaaaggaagtntcatttcccgacttgggctgggttgggttg

SEQ ID NO: 53129 - DNA, 101 bp, rice(Oryza sativa)
  misc_feature (71): n=t or c
ccctgccaccatggccgtgactgtagaccggcccaaactgcaaccatcaaaactctttgattattgcaacntactccctgcatttttgtccttttcccttg

SEQ ID NO: 53130 - DNA, 101 bp, rice(Oryza sativa)
  misc_feature (71): n=t or c
caaactgtgtaggcgaggccgcgagagcaccaaggccagccggccggaaacaaatcgtggcaggcgaaagngcaaacagcagcagtgtggtgtgctgaaag

SEQ ID NO: 53131 - DNA, 101 bp, rice(Oryza sativa)
  misc_feature (71): n=a or g
taagaagagagggaatgcatggatctaataactgtagaaaaatccaccgaagaaatatcgtatgaattgtntacggctcagggaggaagaagattatatag

SEQ ID NO: 53132 - DNA, 101 bp, rice(Oryza sativa)
  misc_feature (71): n=t or c
gttacaaaaccttttgcattgatcatgtaagtttgaatcaactatgctcacgacaattccacttaaacggnatacatgacccaagtcttcatcaacatgaa

SEQ ID NO: 53133 - DNA, 101 bp, rice(Oryza sativa)
  misc_feature (71): n=a or g
caagaactcgattctttttcctcctgaattgggtggttggttccttcctccatgattgatccatgcagccnagcaagaaagagagagacagagagagaagc

SEQ ID NO: 53134 - DNA, 101 bp, rice(Oryza sativa)
  misc_feature (71): n=t or c
gcgcctaaactcaccaagttgacgcactggcagagcctttgtaaatccatctgctaactgatcactagtantgatgaaccgaatgtccaacagcttgcgtg

SEQ ID NO: 53135 - DNA, 101 bp, rice(Oryza sativa)
  misc_feature (71): n=a or g
ttgcgtgtccctgctccacagaatcagcagcattgccaacactgccacaaactgtccatcccccaagcccnacatcatctgccgctgccgcagtcttctcc

SEQ ID NO: 53136 - DNA, 101 bp, rice(Oryza sativa)
  misc_feature (71): n=a or g
tccttcggcccagaatggaaaagcccggcccaaaatattcctgaacactgaagatacaagcagactaacancactttactttttagtgcaccggccgaaag

SEQ ID NO: 53137 - DNA, 101 bp, rice(Oryza sativa)
  misc_feature (71): n=a or g
ctttttttttttgcacaatgtgaaatgaatagattatgaatttgcgggtgaaacttgggctacttaatcantactccatctattttatattataagttgtt

SEQ ID NO: 53138 - DNA, 101 bp, rice(Oryza sativa)
  misc_feature (71): n=a or g
ataattacattgtgatttgtagaagtggaggttttccgtctttttaattcggtaacagtacgtgtgagatnggtgacaaataattttattctaggacgacg

SEQ ID NO: 53139 - DNA, 101 bp, rice(Oryza sativa)
  misc_feature (71): n=t or c
cctgatgaaagaaggtgatgatgatgaggagatttcagctagctaaggatcacattgacgagaatggtgangacgagaattcagcatatttggaccaagag

SEQ ID NO: 53140 - DNA, 101 bp, rice(Oryza sativa)
  misc_feature (71): n=a or g
ccttaaataagaaaaacttcaggattttgcgcggtgaacctaggaaagcagttaggcatttgaactgttcntcaagagtgaggtttcttccaaaagcaaaa

SEQ ID NO: 53141 - DNA, 101 bp, rice(Oryza sativa)
  misc_feature (71): n=a or g
acagttgctgcttataagaaaatcaacaatggctgccttcacatcatcgtgcaactcaacagaatctcctnttttgatgccccacatttcccggaacactt

SEQ ID NO: 53142 - DNA, 101 bp, rice(Oryza sativa)
  misc_feature (71): n=t or c
gcgtgaaactctgtttagagtttcatgaaggccaaacaccatgcggtacaagaagtgggttgatgatgtangaatatttgatagaacagaatgatgaactg

SEQ ID NO: 53143 - DNA, 101 bp, rice(Oryza sativa)
  misc_feature (71): n=t or c
ttcttaggggcgagcggctctccttttggcccaacattggtaacaacatgaaacccttcgtcctttctatncacgcttatcttgccctttttttcttcgcc

SEQ ID NO: 53144 - DNA, 101 bp, rice(Oryza sativa)
  misc_feature (71): n=a or g
tctgtgtatggaaaacaggcacatccacatccgctgaggcagacatatcaatcaactaaaatggaaaaacntccacactcggggatatctttgtacagaag

SEQ ID NO: 53145 - DNA, 101 bp, rice(Oryza sativa)
  misc_feature (71): n=a or c
agtcctccacatccatcatctcagagtcgttgttctgctgctgctcctctccctcatcatcgtcatcgtcntcgtcattgtcatcgtcgtcatcctcgtcg

SEQ ID NO: 53146 - DNA, 101 bp, rice(Oryza sativa)
  misc_feature (71): n=t or c
caaacaatgtgaatgtggtgcacccagtgagttctgtgtcagaatcaacattgatgccacctccggaaggngcaaacaacgtgaatatggtgcacccggaa

SEQ ID NO: 53147 - DNA, 101 bp, rice(Oryza sativa)
  misc_feature (71): n=t or c
tcacgtgatgatccctatccaacttgatgtagtattatggaatggaagttttaggccccgtttggtagggntccaaactccaaactccaactcctaactct

SEQ ID NO: 53148 - DNA, 101 bp, rice(Oryza sativa)
  misc_feature (71): n=a or c
agaggcatcaaagcacaggttaaggacctatctaaagagggcgagtccatgtgtggggccaaggattcatnatctctctcgactgatttggttgaaatttc

SEQ ID NO: 53149 - DNA, 101 bp, rice(Oryza sativa)
  misc_feature (71): n=a or g
atataagaacaacaactaaaatcactattgatactatgttcaaccggtgactagcctggagcttcttcttntgcttcatctgttcttctacattgttatct

SEQ ID NO: 53150 - DNA, 101 bp, rice(Oryza sativa)
  misc_feature (71): n=a or g
aatcaacatattatgaaatcgtaaacgaagatcttaaagcataactgtcagatggcaggaaccaaaatgangcctcaatcttcacaatccgtgctagttgc

SEQ ID NO: 53151 - DNA, 101 bp, rice(Oryza sativa)
  misc_feature (71): n=t or c
aaatattgttcactgagtagaaggcaactacaagaggtagcctgtgaattcaaggctactaaaatcccttnaggtgactagtgcagagcagcatgcagagt

SEQ ID NO: 53152 - DNA, 101 bp, rice(Oryza sativa)
  misc_feature (71): n=a or c
ttcaccaaatctatacctcaaacgacgggcactctcttcgttaacacaatccttaagttgatggatctggntagcaatttcatgacgtgaccataacattc

SEQ ID NO: 53153 - DNA, 101 bp, rice(Oryza sativa)
  misc_feature (71): n=a or g
tattcatccaacagtttatattaagagttgatcacccttacaattagcgatcccgcctccactattctgcngttacgaaaaggaagagaggaataaactaa

SEQ ID NO: 53154 - DNA, 101 bp, rice(Oryza sativa)
  misc_feature (71): n=t or c
ttttgcttcacaatgaagaactggaccttaagaggttgaactttggtgttatctctctgatcccaaagagnagcaatcccacatacattaagcagttcaga

SEQ ID NO: 53155 - DNA, 101 bp, rice(Oryza sativa)
  misc_feature (71): n=a or g
gtgcagtttcaggaactggcaattttaacaatactaagcatatgaagtactagactagagagacagagagnagggagaggagggggaagagagagtgtgct

SEQ ID NO: 53156 - DNA, 101 bp, rice(Oryza sativa)
  misc_feature (71): n=t or c
tgggtctcagcactatctctccttcacttttcatcccctctccttcacttttcatcactttgcatgtttgncttttccagttttccctagcatagaggaag

SEQ ID NO: 53157 - DNA, 101 bp, rice(Oryza sativa)
  misc_feature (71): n=a or g
tccacaggagcaaggtctgaggcctcgcccaaccaatggtttcatgagtccaaacatggggagagccgtcngtgacattgagatgggtagaaagccggtgg

SEQ ID NO: 53158 - DNA, 101 bp, rice(Oryza sativa)
  misc_feature (71): n=a or g
aagaattgcctgttgatttactgtttcaagtgccagtagacagttcatgattttggtacacctcttgcagntggttattcttctccatatcgttattacaa

SEQ ID NO: 53159 - DNA, 101 bp, rice(Oryza sativa)
  misc_feature (71): n=a or g
agtcatgaggaccaaactgcggagcaactggcagccaaacaagaaccgatcgatatatcacacatgagagnaaataaacagtgttgtaacagatactagca

SEQ ID NO: 53160 - DNA, 101 bp, rice(Oryza sativa)
  misc_feature (71): n=a or g
ctccctccccagcttgctatattttggaaccgaggggaagagtaataatatttatactagcacagtgtccntgtgttgccacggaaacaatcaaattttat

SEQ ID NO: 53161 - DNA, 101 bp, rice(Oryza sativa)
  misc_feature (71): n=t or g
gaagtctcacatattctattaggctgttttagtgctagttttagtgctagtttccaatttttacttctagnttttaccatgcacgtttttcaaaatactaa

SEQ ID NO: 53162 - DNA, 101 bp, rice(Oryza sativa)
  misc_feature (71): n=a or g
tatcatatatcttagtcaatctggtttgacttctcgatttaatcttatcgaccgagatgattgcaaaggtnacagaggagcagtttggaattaaacctaag

SEQ ID NO: 53163 - DNA, 101 bp, rice(Oryza sativa)
  misc_feature (71): n=a or g
cgctgagttcacggtggaccagaccagcgtacaggatttcttcgacatctccctcaccgacggcttcaacntgcccatggacttcctccccgtgccggctc

SEQ ID NO: 53164 - DNA, 101 bp, rice(Oryza sativa)
  misc_feature (71): n=t or c
gaaaaaatcctgacaattcaactcttcgacctagtcaggtaaacctcttaaatcatgctcctgctcccgcnatccagttgctgtctacataaattacaaga

SEQ ID NO: 53165 - DNA, 101 bp, rice(Oryza sativa)
  misc_feature (71): n=t or c
tggcttgacagcagcagagagaacatctgaacctgaagaatcaaggaagttgcaggtactgtacatcattngtattatattcagtaattgtagttacgcaa

SEQ ID NO: 53166 - DNA, 101 bp, rice(Oryza sativa)
  misc_feature (71): n=t or c
atgcatgcacatgcatctgcaactaactaacactaccagagaaagcgtttttcctctcggtttgtagcccnctatactcctagttttataaccagaagtac

SEQ ID NO: 53167 - DNA, 101 bp, rice(Oryza sativa)
  misc_feature (71): n=a or g
tcgatgggaaagagaaatgggtagcaatgcactgggtgattgtgtcatacccatggcaaaatttgctacangacactcaaagattgtggtctttgctgtaa

SEQ ID NO: 53168 - DNA, 101 bp, rice(Oryza sativa)
  misc_feature (71): n=t or g
caatgtatgatccagatagatactttctcagaatacttgcgtaccttagggagaacagggtggatttgtgnacgctgatggagatggagctctccctcatg

SEQ ID NO: 53169 - DNA, 101 bp, rice(Oryza sativa)
  misc_feature (71): n=a or g
tgttgagtataacattgaactaggtttaaaattgcaaaaataacgacagtaatagcatgcagcagcagcancaacaattgaatagttctttaaggttctta

SEQ ID NO: 53170 - DNA, 101 bp, rice(Oryza sativa)
  misc_feature (71): n=t or g
cgcattgttagacatctcaaaagttcaagatgatgaagttggtgacgggacaacctctgtggttgttttgnctggagaacttttgagggaggctgaaaagt

SEQ ID NO: 53171 - DNA, 101 bp, rice(Oryza sativa)
  misc_feature (71): n=a or c
agcctgagaaagcgaagagatggaagctcagcgaggcgatcaaggtggtcagactggagatattcaaaacncagccaaatggataaggtggtgaggcggga

SEQ ID NO: 53172 - DNA, 101 bp, rice(Oryza sativa)
  misc_feature (71): n=a or g
tctcaaaatctccaggttgttctcctgccaaaccttctttactttcttacatttgaaaaacaggtgcccancatcctcattcattctattgcatattatac

SEQ ID NO: 53173 - DNA, 101 bp, rice(Oryza sativa)
  misc_feature (71): n=t or g
tctgcaggccttctgaaatagccaccgtactggggttcagttgagcctcctagtagttttctttccattanagtttgagattgtttcctcgtgggatggca

SEQ ID NO: 53174 - DNA, 101 bp, rice(Oryza sativa)
  misc_feature (71): n=t or g
caaagagatagatcttactttcctcaagagaattgtcggtgttcgaccgaccagcaacaatctctagtgcnaccaccccgaatgcgaaaacatcaaccttt

SEQ ID NO: 53175 - DNA, 101 bp, rice(Oryza sativa)
  misc_feature (71): n=t or c
gattattatttttattggtttggtgatatactcgtcgacataggaatatttgtgatgatttcgtcaatctnaaaatatatcaaccagtatttaaaggtata

SEQ ID NO: 53176 - DNA, 101 bp, rice(Oryza sativa)
  misc_feature (71): n=t or g
aattttccaattgatcgtgggatctctccagaaagcttgttgttggacaaacttaggattgacaagttttnaagatttactagtgtgtcaggaatttggcc

SEQ ID NO: 53177 - DNA, 101 bp, rice(Oryza sativa)
  misc_feature (71): n=a or c
attatgaacgctagagagagagaggaggtgatggaagaagtgaataattgtatgacatgtggggcctatcntattttatttttgtattttactaattatgc

SEQ ID NO: 53178 - DNA, 101 bp, rice(Oryza sativa)
  misc_feature (71): n=t or c
gatgtttgttggatggcttgtgtgcccccatgttgcgccgatgaaatgtatgccgtcaactggaaaacacntttgctttcaatactaaaagcaaagtattg

SEQ ID NO: 53179 - DNA, 101 bp, rice(Oryza sativa)
  misc_feature (71): n=a or g
tgtccatgtgtttttaaccgttgtcaattctagtcgttgcctaagtttaatgcgccatgtggaacatcaanttttatttctcttaaaatgagtttgatatt

SEQ ID NO: 53180 - DNA, 101 bp, rice(Oryza sativa)
  misc_feature (71): n=a or g
atatggtcgagactgctgacatgttttcaaagtacaaacgtcagttgacatatgaacctaagaaactgccnatacaactggtcgtttttgacggcgaaagc

SEQ ID NO: 53181 - DNA, 101 bp, rice(Oryza sativa)
  misc_feature (71): n=t or c
ggtgagcggaatgaaaacatgcaatctgaaagccagtcttcgactccaagctcaagttttgttagtgatancagcactcctggaaagtggtacacacccac

SEQ ID NO: 53182 - DNA, 101 bp, rice(Oryza sativa)
  misc_feature (71): n=a or g
cacaacagatcaaaatcagtaaccaaatcgcagtcaagagcgagctttcgatgagcatacctttggaactngtggaggaagggcttccagaaccctatggc

SEQ ID NO: 53183 - DNA, 101 bp, rice(Oryza sativa)
  misc_feature (71): n=t or c
attctgagagcatgaccttgacagcaatttttccatggattggcctgactgaaacaagaacacggcacatntattcgatgaaccaaatagccagtcatgaa

SEQ ID NO: 53184 - DNA, 101 bp, rice(Oryza sativa)
  misc_feature (71): n=a or c
agattctcaaatcctcctgctggaactaagatttccccatcagagtagttcttgttctcctcaagaatggntgttgacagtggatcaggctttgcgcctga

SEQ ID NO: 53185 - DNA, 101 bp, rice(Oryza sativa)
  misc_feature (71): n=a or g
gaattcctcggagttccggtgagaaagctggtcagcaggcaggtgaaaattcacactagtcctcttccagnccttgtcaggaactgggatgatgtgagcaa

SEQ ID NO: 53186 - DNA, 101 bp, rice(Oryza sativa)
  misc_feature (71): n=a or g
tgaagtagtcggagatgaagtcgaggtcaccgaacctgttggcttgtcctagggggaatacgaagtcgtcngctcctgaagttgatcccattgcacttgtc

SEQ ID NO: 53187 - DNA, 101 bp, rice(Oryza sativa)
  misc_feature (71): n=a or c
atggatatactattgtggttgatactagtgttattattgcttatagatacaattgattaatgccatacatnaaaaagacaaggtaattctattttctcctt

SEQ ID NO: 53188 - DNA, 101 bp, rice(Oryza sativa)
  misc_feature (71): n=t or c
cggtgagtttgctgatacaattgttgcagatggtcattgcttagatattcttgtgttggagaatagtaganaacatttgtaatcatggttcatggaacctt

SEQ ID NO: 53189 - DNA, 101 bp, rice(Oryza sativa)
  misc_feature (71): n=t or c
tagagctaaggtggagggctggacgtacgaaggaggagaggtaggggaagaaaatcgacaaggagacaacnggccttcaggtcgccgccgttcgccgttca

SEQ ID NO: 53190 - DNA, 101 bp, rice(Oryza sativa)
  misc_feature (71): n=a or g
cagagattttgtaggtgatgttggaccagataagaacttaggtgttgaaccaggagttaatttaggagctntgtatggtgtgactgagaactgatgttctg

SEQ ID NO: 53191 - DNA, 101 bp, rice(Oryza sativa)
  misc_feature (71): n=t or c
cctcaggtcgtaacaggattaaaaatatggttggcagattaccgcttattcgatatgatcaacagctaacnagctaggagtagcgaattaatgaacgtata

SEQ ID NO: 53192 - DNA, 101 bp, rice(Oryza sativa)
  misc_feature (71): n=a or g
gtctacctccggggagcgctctacatgcattgccagaatgattgcgtcatcaagatcacacttaacgaccncaagtatcgggtcatcagattgcctggcga

SEQ ID NO: 53193 - DNA, 101 bp, rice(Oryza sativa)
  misc_feature (71): n=t or c
gcttggtttatctgaggttgatgaaggcgacatcgtgaccatcactctggacaacttgacacctaagcagnagaaggatcttgaagcaatgatgcaacaag

SEQ ID NO: 53194 - DNA, 101 bp, rice(Oryza sativa)
  misc_feature (71): n=t or c
catgagctatccacatattcaccaatatgccaggctcaaaataatagccttttgggaacaaaccacagaangaaaaacattgctgaaggtgctctggcaag

SEQ ID NO: 53195 - DNA, 101 bp, rice(Oryza sativa)
  misc_feature (71): n=t or c
cttcccagctagtaccggttttgtgttttgtggtggggccctttttggtgtacttttgggggtttcatttncaagcctagctggcacatgttgcttgttgg

SEQ ID NO: 53196 - DNA, 101 bp, rice(Oryza sativa)
  misc_feature (71): n=a or g
ttaaaacgaaattaatctagattttttaacctataacatggctagctagtgaccagcgacaagcttgaacngagtatacaaccgcttagagcaggtacaat

SEQ ID NO: 53197 - DNA, 101 bp, rice(Oryza sativa)
  misc_feature (71): n=t or g
aatgctgcgtccataccgttgaacatgttattctaagcacatgattgccttttgaagatgagagttaattntgttcattttagtggtgtaggtggcaattc

SEQ ID NO: 53198 - DNA, 101 bp, rice(Oryza sativa)
  misc_feature (71): n=a or g
ggagtactgtttatattggacaactgtatatatgttagtgagttacgtaggagtacgcacatttgcacgtngtacaattgcctgtcgatcagctggggatg

SEQ ID NO: 53199 - DNA, 101 bp, rice(Oryza sativa)
  misc_feature (71): n=t or g
tccgaataaggaaagagaagcaaagtcctacttgagcacgacaagcaccactcttatcgtatccatacttngttatctaattctacatagacaagaggaca

SEQ ID NO: 53200 - DNA, 101 bp, rice(Oryza sativa)
  misc_feature (71): n=t or c
ttgcagctcttcatcaccattgaagccacgttactctagattctgaacctaatgctctcggtagagatggntttcccttataacattcttgcagtcaaata

SEQ ID NO: 53201 - DNA, 101 bp, rice(Oryza sativa)
  misc_feature (71): n=t or c
cagatccagccaccgccgaggttggggcgccagatttggcaaggacgacaggccggcaacaggaggccttncttggctcgatcgggggcttggcgacctct

SEQ ID NO: 53202 - DNA, 101 bp, rice(Oryza sativa)
  misc_feature (71): n=t or c
tctcttgctcgtgtcgaaggcgacttagttcgtcttgctcctcgatctccctctgcaataagtcgatctcnttgtcccatatccaggtgttgagtatctcg

SEQ ID NO: 53203 - DNA, 101 bp, rice(Oryza sativa)
  misc_feature (71): n=a or g
ttacttccaaacaaaaacatgctcatgacaaatacagttatttttgcacaagtcggaacaattgcttcagntacaaccttttcaagaagaaccaaaacttg

SEQ ID NO: 53204 - DNA, 101 bp, rice(Oryza sativa)
  misc_feature (71): n=a or g
catagtaagcaaaacagtctgtatgttttgatttttttatgttaaatctgacatgcatgagagattggaanttattttgcatatttagttgtagcttctat

SEQ ID NO: 53205 - DNA, 101 bp, rice(Oryza sativa)
  misc_feature (71): n=a or g
tgccggttgcctctgggccgatcttctcgcctaagcttttggtttcgacgggttaggccgaaggcccttcntggtatgcctcaaacaatacccatggggag

SEQ ID NO: 53206 - DNA, 101 bp, rice(Oryza sativa)
  misc_feature (71): n=t or c
actagctagaggcaggaagagacggggaaattgtcgtgtggtaagggagaaattcgtttttgttggcgtgntgggtccgacttggcgttggccaagtgttg

SEQ ID NO: 53207 - DNA, 101 bp, rice(Oryza sativa)
  misc_feature (71): n=a or g
ccattggggatagacaattcatgcgccaacaagatagagagttcacatgcacgtatggacttgataattcnttgtaagatgcacaacggatgcaataagaa

SEQ ID NO: 53208 - DNA, 101 bp, rice(Oryza sativa)
  misc_feature (71): n=t or c
gcaaaatgccccagtaactcaaaccaagaagaactgcaaggaactcacatgagattggttttcaatagtanaaggatcttggatagttctctttcttggcc

SEQ ID NO: 53209 - DNA, 101 bp, rice(Oryza sativa)
  misc_feature (71): n=a or g
aactgaggcaactggagttgctggttgagactagtgcaaataaacagtaaggaattttcaggtcatgaacnaaacaaagacactcaaaagttatgcagaaa

SEQ ID NO: 53210 - DNA, 101 bp, rice(Oryza sativa)
  misc_feature (71): n=a or g
ataaagctagtttgttcgtatgtatagtgatgcgtttgtgcgtgcttttgcagtttatttgaaacaagtcngtttcattgagaattggaacttgaagcgga

SEQ ID NO: 53211 - DNA, 101 bp, rice(Oryza sativa)
  misc_feature (71): n=t or g
acccaccacggccgccgtcgttgtcgctgctcccgtcctactgggatccattggacgaggacgaaagaagncggcgtcaggatccgaaggtgcaccagctg

SEQ ID NO: 53212 - DNA, 101 bp, rice(Oryza sativa)
  misc_feature (71): n=t or c
gtgcaattctacctactatacagatgcatttatcatctccaactgtaattcatgcatgtatggagcacaancagtttttcagccaggtctcaactaagaaa

SEQ ID NO: 53213 - DNA, 101 bp, rice(Oryza sativa)
  misc_feature (71): n=t or g
atacgagcttcatcgacaacttcacttatcttctggtgtctccgtcatgtatgtgccatcgattttggttncatgcatttttttttcttttgcatattttc

SEQ ID NO: 53214 - DNA, 101 bp, rice(Oryza sativa)
  misc_feature (71): n=a or g
ggatctgtgcatgcatctcactggtcaaaaacagggttttgtacgtgcatctcaatgaccaacatggattnatttgatcgatccaaaataaaaaataatgg

SEQ ID NO: 53215 - DNA, 101 bp, rice(Oryza sativa)
  misc_feature (71): n=t or c
gctataactcgaaactgagagtgccagattgccagttcgtacgtaagtacgtacccgtcagttttgacgtngtaccgagggtgctttcctgccacgaaacg

SEQ ID NO: 53216 - DNA, 101 bp, rice(Oryza sativa)
  misc_feature (71): n=t or c
tcgtcgacgaggtcaccgtcatcaaggacaagagacctctttgtgatctgtacacccagatctaggctcgngacctccaagctcaggtgttgtcttgttct

SEQ ID NO: 53217 - DNA, 101 bp, rice(Oryza sativa)
  misc_feature (71): n=t or c
ttgttctcttaacacatcacccaacaaagcaaaaccttggtactcggtctcggtatatagtttatgatctncgatgtgcgacgactttggctataattata

SEQ ID NO: 53218 - DNA, 101 bp, rice(Oryza sativa)
  misc_feature (71): n=t or c
cgcgcgcgtgcgcttcgctcgagtcgcgtcgcgtccccactctccaagatcctcctagaagaagtatccancatcaccaccacttcgctttcccagggagg

SEQ ID NO: 53219 - DNA, 101 bp, rice(Oryza sativa)
  misc_feature (71): n=a or g
tttttattattataggtagctatccacctagctggggatgccatcgatcaaatgaagagcatcaagatatncctacaatattgcatttaattaattaggag

SEQ ID NO: 53220 - DNA, 101 bp, rice(Oryza sativa)
  misc_feature (71): n=t or c
cggagattgtttgcccttgggtcacgaacgatattacgcatctgccatcgttaacggattggctttaattngaattccatttggaagctactgccggcaag

SEQ ID NO: 53221 - DNA, 101 bp, rice(Oryza sativa)
  misc_feature (71): n=t or c
taggtcagctccagtgtttcggagttcagatatcaaagttgcaggtgttctcgttaaagaatttccagctnatattcagaatgtcctttaagaaaaaggca

SEQ ID NO: 53222 - DNA, 101 bp, rice(Oryza sativa)
  misc_feature (71): n=a or c
ttaataactgacctatttcagtttgacacaaattgggagctactcgaccatcgcccggcctttttaccttngattgaaattggagtgaaatgtaagagtga

SEQ ID NO: 53223 - DNA, 101 bp, rice(Oryza sativa)
  misc_feature (71): n=t or g
cgggccgacatgataggttgcgtctttctcttcatgctgtcacacacaacatctgtattctctagccactnattatcttgtccaaacagcaaaatgccctc

SEQ ID NO: 53224 - DNA, 101 bp, rice(Oryza sativa)
  misc_feature (71): n=t or g
acctgtgttgctactagtctccctctggttttcttgtacaccaaagaaatgcttgtcatttacactaatgntgttgtcttattgacctcctatgttgcagt

SEQ ID NO: 53225 - DNA, 101 bp, rice(Oryza sativa)
  misc_feature (71): n=a or g
gaacgaccggggaatggacgaatggttagtgatggatggtaaccagctgtttgatgttaaaataaaccttntcaaaatttaataataccaatagtattata

SEQ ID NO: 53226 - DNA, 101 bp, rice(Oryza sativa)
  misc_feature (71): n=a or g
ttgtgcgaatgcatacagtgatctccatcttcgctctgaagaagagaagactcgactcggccaaaacaatngcagagttcctagcttcatttcagacttag

SEQ ID NO: 53227 - DNA, 101 bp, rice(Oryza sativa)
  misc_feature (71): n=t or c
agaatgagcacctccaaaggagtatcagtcacaatgtactcgactacagggagcccaagagaagccctcgnggcatccgcaacctgcaagtgacggagtcg

SEQ ID NO: 53228 - DNA, 101 bp, rice(Oryza sativa)
  misc_feature (71): n=a or g
tatttatggtacagagaggtggtatcacctccaaggtatggttaccctcacatgtgagtactatcataccnatgctcttctagcgagtataataagcgata

SEQ ID NO: 53229 - DNA, 101 bp, rice(Oryza sativa)
  misc_feature (71): n=t or c
ccttcttcaaataaggcaagctccgtttctgacaaaaataattaaatcgagaaagccgtcaacgatggtgncgcctccgccgatggaaaatccgcgatttg

SEQ ID NO: 53230 - DNA, 101 bp, rice(Oryza sativa)
  misc_feature (71): n=a or g
gattaaaacctaattaatcatcctctaatggttttttcattttacacgctcgtacttaatcttcattttcnttaaactcaaacgaattattctaactaatc

SEQ ID NO: 53231 - DNA, 101 bp, rice(Oryza sativa)
  misc_feature (71): n=a or c
tcatggttttactttactctatacccaccgatcttgtaatcgtgtagctcatgccttagcgaagctgatgncaggctgggtgagtggcattcagtcccagc

SEQ ID NO: 53232 - DNA, 101 bp, rice(Oryza sativa)
  misc_feature (71): n=t or c
ctcggcgatgtcctccgtggagctgacgaggttgtacatgaggaaggcgtaggtggtgaagtagtccttgnccttccgcccttgggtttgctggtcttgtc

SEQ ID NO: 53233 - DNA, 101 bp, rice(Oryza sativa)
  misc_feature (71): n=a or c
aaagcttatctacaggtggttatattactgcaaattgtcttcactcgattcgaacatgacgactactactnctacatgattattgctagcgctgctgctcc

SEQ ID NO: 53234 - DNA, 101 bp, rice(Oryza sativa)
  misc_feature (71): n=a or g
caacaagcgacaacggcaggggctcgagcaccgtatgtcggacgtcaagaacaacctgtcaaaaatccgtngctcactgcaggtcacctacactggtctgc

SEQ ID NO: 53235 - DNA, 101 bp, rice(Oryza sativa)
  misc_feature (71): n=t or g
gccaagctcctcgagatgtaagctcatctgctacagctctaaggactgctgatgctccaaaaccacgccanccatcaaaatatataactcttgtgtccctc

SEQ ID NO: 53236 - DNA, 101 bp, rice(Oryza sativa)
  misc_feature (71): n=a or g
tgcataccctctatcctacgagtcatggaatgtagggatatcttcgtatgtacggtaaagctctgtatgcnataaggaaatcgacaaaagattatggaaat

SEQ ID NO: 53237 - DNA, 101 bp, rice(Oryza sativa)
  misc_feature (71): n=t or c
ttctgacccaacacctaatgagacaacattaacatgagcttcaccattttgagcaccttgaagcgaagtcnctgctccaccaggtacagaggccagcatat

SEQ ID NO: 53238 - DNA, 101 bp, rice(Oryza sativa)
  misc_feature (71): n=a or g
gagattgcacattctgagcaggctcaatcgaacgatacgaaccaggctggacggtatgcagggatcaaacncactcttttggccttttacttcttctcttt

SEQ ID NO: 53239 - DNA, 101 bp, rice(Oryza sativa)
  misc_feature (71): n=t or c
gttaatagacatttagacaactttgatgggttagaacaaattaccacaccacctagccatcatagattagnttgccccgccaagatagcttaattctacac

SEQ ID NO: 53240 - DNA, 101 bp, rice(Oryza sativa)
  misc_feature (71): n=a or g
atttttataatagtagagatatcgttgtgacttttagacacactgtttattatcactagatgggtaccccncacgttactgcggaagaaatatgtgataat

SEQ ID NO: 53241 - DNA, 101 bp, rice(Oryza sativa)
  misc_feature (71): n=a or c
gaaacatttttaaataggtcctatttgttagtaaaaaaatgccatgtcatgtttgtgtgggataccacatnagcgtcacgtaggattctaaaggggttgtg

SEQ ID NO: 53242 - DNA, 101 bp, rice(Oryza sativa)
  misc_feature (71): n=t or g
ttaatggaaataacaactaatttgttttgaaagaaataaacataccgaaaaggatggtatccaagcttctnttgggcatgtactcatacacgagcaacttt

SEQ ID NO: 53243 - DNA, 101 bp, rice(Oryza sativa)
  misc_feature (71): n=t or c
ccccttcttgagcgccgcgtccgccgagtccaggttggatttcatgtcgtcgtacatctggaggcagtcgnccatggcgtccttggacacctcgtccccgg

SEQ ID NO: 53244 - DNA, 101 bp, rice(Oryza sativa)
  misc_feature (71): n=a or g
gaaaaccgaaacaggttggcagtttcttaccatctctcagggatatttttctccttcggaaatcatggttnacatgtttgatgtagtgttaattgcttcta

SEQ ID NO: 53245 - DNA, 101 bp, rice(Oryza sativa)
  misc_feature (71): n=a or g
ctgaaatcttttttacttccatccttaatatccttgtcgaaggctaaaatcattaccccatctatttcatntgaaaccggggagtatattttaaaacgaag

SEQ ID NO: 53246 - DNA, 101 bp, rice(Oryza sativa)
  misc_feature (71): n=a or g
acgaccaccacagcttggaatgcataaatacgcctccatgttatttgtacgctctcttgtctcttcatatnactcgtgcaatgctacaatcattttctcca

SEQ ID NO: 53247 - DNA, 101 bp, rice(Oryza sativa)
  misc_feature (71): n=a or g
acattagtcctctcttttagcagagaggccagatatcctattccgcgcttacgcgccgggaagagaaatcntgtgcacgtggcacgcggttttcgagaggc

SEQ ID NO: 53248 - DNA, 101 bp, rice(Oryza sativa)
  misc_feature (71): n=a or g
atgcaaaaatacggccacgctgtactgccatatttgcactcaaacctagtcaggcgagcttttcgacctgnatggtgcatttacggacccaaatattggat

SEQ ID NO: 53249 - DNA, 101 bp, rice(Oryza sativa)
  misc_feature (71): n=a or g
taggagtagttactttcctgttctaaactccaactagatacatagggcttgtttgggagcttaaaactctnagaaacagctgctgagaagctagctgtgag

SEQ ID NO: 53250 - DNA, 101 bp, rice(Oryza sativa)
  misc_feature (71): n=a or g
tcatttcagaaacaagctagtaagaaggcttaggcttgactcgttttggtttcgagccgatccgaactatncgagcccaaaccaagtctgagctttttatc

SEQ ID NO: 53251 - DNA, 101 bp, rice(Oryza sativa)
  misc_feature (71): n=a or g
ttctatagctacatattctccaggtaacaatctagatttgagagagtttgggattatgtgagaatctttcntcaagcaagacaacagattttgctcgagat

SEQ ID NO: 53252 - DNA, 101 bp, rice(Oryza sativa)
  misc_feature (71): n=t or g
ccatacgatcgaggccatgtcttaccgataatgggagtattagagttgtaagcgatagaccacaacaacangattgtaaaaggtctcagataaaagcccaa

SEQ ID NO: 53253 - DNA, 101 bp, rice(Oryza sativa)
  misc_feature (71): n=a or g
ttccatgcatcaatagtgatcatgtggctagcagtttagcctctgtctcaggcaattataagcagcagtanaagtagaatctcacatagggtgttgcaaac

SEQ ID NO: 53254 - DNA, 101 bp, rice(Oryza sativa)
  misc_feature (71): n=a or g
catgcagatcagctccgaattaaaattaatggagccccgacaaaaggtaaaaaacaacttggatgtgggcncatatcctgcagagaggaaacattcctctc

SEQ ID NO: 53255 - DNA, 101 bp, rice(Oryza sativa)
  misc_feature (71): n=a or c
acatttcctacatctccgacgacgcgtacatagcaaccggagagaagcacgagatttcatcggaatacaanagccgagcgctatacacgtcaggccttagc

SEQ ID NO: 53256 - DNA, 101 bp, rice(Oryza sativa)
  misc_feature (71): n=t or c
aacacgatacacggaccaaaggcctaaatacgatgacacagcacttgaagacatcaacttgttcggtcaantagaaaggaaacccgcgcagatgcgcgggt

SEQ ID NO: 53257 - DNA, 101 bp, rice(Oryza sativa)
  misc_feature (71): n=a or c
catcactcccgtgcaatggtgaccagctgcttgccgacattgcggccagtgaatagcccaatgagagctgncggtgccgcctcgagcccctcaacgatgtc

SEQ ID NO: 53258 - DNA, 101 bp, rice(Oryza sativa)
  misc_feature (71): n=t or c
cttggtcaattcggtcataggcctcagctaatcaagatgaccgaattgaatgagtttagcccaataggccnagagaggaagcactaaatccccatgtccca

SEQ ID NO: 53259 - DNA, 101 bp, rice(Oryza sativa)
  misc_feature (71): n=t or c
cgtacgtccctcccactcccagttttagtataccttagcgtttgctgaggagagaaaagggccatgaattntaagcatgatgatgatgaggtgcagaagat

SEQ ID NO: 53260 - DNA, 101 bp, rice(Oryza sativa)
  misc_feature (71): n=a or g
cgacgaggaagcagcagcaggggcagagcaggaggaaatggaggaggaggacgtgaagggcggcatcgcgnggagcgccatggcggcgtcgtacaacgacc

SEQ ID NO: 53261 - DNA, 101 bp, rice(Oryza sativa)
  misc_feature (71): n=a or g
cttatctatatttgcagttaaaaatacgccagcaacacggtccctggggttcgatccatgaacattttctnatcatgcatgcgtacgtacgtgctaactca

SEQ ID NO: 53262 - DNA, 101 bp, rice(Oryza sativa)
  misc_feature (71): n=a or g
acgccatgcaagcaaagaggagacagcaagaagttaccttactgatctcattagcagaaacctgatccagncattgcatctgagacataatggcaccccaa

SEQ ID NO: 53263 - DNA, 101 bp, rice(Oryza sativa)
  misc_feature (71): n=a or g
agaggaatcaaattaaggaactcagccattgcggaaccggaatgttctcccaagttaactatgactagccnagctcctttgcatcgcatcgcacgctattt

SEQ ID NO: 53264 - DNA, 101 bp, rice(Oryza sativa)
  misc_feature (71): n=a or g
ttaggccacctttggaacacaagaatcgtaaacggcaggaatagaagaaaaaggattttggtagaaatgcntatgcaaaatagagaaatagaaaacacatg

SEQ ID NO: 53265 - DNA, 101 bp, rice(Oryza sativa)
  misc_feature (71): n=t or c
aatgggtattttgaaccttgagttttcagtgcatcctccgacaatatcaacgttattataccagacatcanagttgcaatggctattaatcccacgaatcg

SEQ ID NO: 53266 - DNA, 101 bp, rice(Oryza sativa)
  misc_feature (71): n=a or g
ttgtggtttgccaatgccatacattaccatccacaaaaagaaaggatataatcgattgtctcttggtgttngtcgcagcaatacacattgtcccgggagtg

SEQ ID NO: 53267 - DNA, 101 bp, rice(Oryza sativa)
  misc_feature (71): n=t or c
ggcgctgcgccgcaatcgcgagaagaggacctctgtgagtcaacaccacaaccttcatgcgtttagaagtntgaacgagtgctcgcgtttgcatgtgtggg

SEQ ID NO: 53268 - DNA, 101 bp, rice(Oryza sativa)
  misc_feature (71): n=t or c
gactgcgtggccagatgggtacctgggtctctttaacatcagcaacagagggaattcaagtaaccgcatcntcgcagtcgagctcgacacctttcagaaca

SEQ ID NO: 53269 - DNA, 101 bp, rice(Oryza sativa)
  misc_feature (71): n=t or c
tatcaacggtggccaacaattccccctgaacttcctgattgcaagagctacatcaaatccatccattgtangcatggtgaggtcaagaaccaccagctgga

SEQ ID NO: 53270 - DNA, 101 bp, rice(Oryza sativa)
  misc_feature (71): n=t or g
aactagtccaaaagcctgtcacatgcatggttacgtattgatggcattatagaaagcctttactttgggtntgtttagtttacgtcaaaattggtagtttg

SEQ ID NO: 53271 - DNA, 101 bp, rice(Oryza sativa)
  misc_feature (71): n=a or g
acggtgctcaactgatgtgctacgactaaaagtctaaaactagtggacagttagggggacgtgtgggactntggggccacctcgttctgttgtgcattgtg

SEQ ID NO: 53272 - DNA, 101 bp, rice(Oryza sativa)
  misc_feature (71): n=t or g
gctgcaaaggaaaaaggatccaaaaatatccccagcacttactgttcggtttagcatgaggcccttttcgnttagttctccccaagccaatggacatgcag

SEQ ID NO: 53273 - DNA, 101 bp, rice(Oryza sativa)
  misc_feature (71): n=a or g
tccaatatcaaacagggggatctcctcaaccccagtttgttccttagcttaaccaatttgatccgatacancagcagatgcaaggagtgccctagcagaag

SEQ ID NO: 53274 - DNA, 101 bp, rice(Oryza sativa)
  misc_feature (71): n=t or c
atcgtggcatgtttcacatgtcatttgaacttcaaattcttgtgcagtaccggacacctccaccttatcanaagcacgttcatccaagcgcttcatgagga

SEQ ID NO: 53275 - DNA, 101 bp, rice(Oryza sativa)
  misc_feature (71): n=t or c
agcaaacaacacacgatctaaaagctaacgaaactactattccgggaaagattggattttaggtcagctcngggagaaacttcacttgaccttcgcagaac

SEQ ID NO: 53276 - DNA, 101 bp, rice(Oryza sativa)
  misc_feature (71): n=t or c
cacacgccgtcgccgccgtcggcgacccttttgtgtccagcaacgaatgaactgttggtgtagtcgatgcngaggacgaggatttgcgagcccctcaacga

SEQ ID NO: 53277 - DNA, 101 bp, rice(Oryza sativa)
  misc_feature (71): n=a or c
ctccgctgcgatgcggtctctagaacctcactcctcactgcgagatggtccatataaataagtccctgtcngtcctagcaaggagcgaagggtaccctgca

SEQ ID NO: 53278 - DNA, 101 bp, rice(Oryza sativa)
  misc_feature (71): n=t or c
tgaaatgatcatacataactgcaagaaacgtcgtcgtccttgttgccgccatggtcgatcatgctcaaatngtcgactacggtcagggagacgccagcgca

SEQ ID NO: 53279 - DNA, 101 bp, rice(Oryza sativa)
  misc_feature (71): n=a or g
attacagaagcacatattttcaaggtatttcgttccctatgaacaacggaaatagaaaatacgaaatacanacaaacatacttttcctgaacaattacaaa

SEQ ID NO: 53280 - DNA, 101 bp, rice(Oryza sativa)
  misc_feature (71): n=t or g
tatttgaaaaacaattaatcctaagaggcatgcatgcatgagccagatactaggaaaaaaaatatgtagtngaaaccatggaaaaatataatatgatatac

SEQ ID NO: 53281 - DNA, 101 bp, rice(Oryza sativa)
  misc_feature (71): n=a or g
ttgttccaaatatgaattgctacctctgcaggtggaggccttctgaagaaaaatcgagctcttaggggtgngaaaaaattgaattctatttatgattctgc

SEQ ID NO: 53282 - DNA, 101 bp, rice(Oryza sativa)
  misc_feature (71): n=t or c
tttatgcaataaaatgtatttataccttgtccaacacatggtcaagaagcagcagaaggtgttggtggccngtgaacgggaccctgagccagccggtggtg

SEQ ID NO: 53283 - DNA, 101 bp, rice(Oryza sativa)
  misc_feature (71): n=t or c
ttgcgtcgtcgactgcgatgcccacgatttgttaaagcaacaagaagctggttattctcggcgcacacatnggagtttgatcagcacgggacgactatacg

SEQ ID NO: 53284 - DNA, 101 bp, rice(Oryza sativa)
  misc_feature (71): n=a or g
ggaacgacgagctcgcttttacgcagatgatcaagatgatcaaagtacgccacaataatgtggttccaacnatggcactgggagttcaacagctcaagaac

SEQ ID NO: 53285 - DNA, 101 bp, rice(Oryza sativa)
  misc_feature (71): n=a or g
aggaagatgtatccgttcacgttttgtgcttctaatatattaagttcttagaaaaaaacttcgacggtttntactccctccatactcgtaaaggaagtcgt

SEQ ID NO: 53286 - DNA, 101 bp, rice(Oryza sativa)
  misc_feature (71): n=t or g
atgaaaagaggtgcaaaacaaaggagtcaaatacacggcaagaacaaataaaagggtgtatggaacaaagnagccatgaaacttataaaacaaattacagt

SEQ ID NO: 53287 - DNA, 101 bp, rice(Oryza sativa)
  misc_feature (71): n=t or c
caacagaaggtcacagaggagatgaatgacagcttatgtgctgaattcagtgaggaagagatttcccatgngatgtttcaggtcgggcccctcaaagcccc

SEQ ID NO: 53288 - DNA, 101 bp, rice(Oryza sativa)
  misc_feature (71): n=t or c
tcatgaccggagtaaacacatcgccacatgctaccacttcatccatgagtgcgtggaggacgggagagctnaggttgagttcattggcaccgatgggaagg

SEQ ID NO: 53289 - DNA, 101 bp, rice(Oryza sativa)
  misc_feature (71): n=a or g
gcggcaacggcggcggtggcggcgatagcctcgtcggtgaaaagggcgaccaacaaccggaggaaacaacngcgcgccaaagtgcaatctggccgccagca

SEQ ID NO: 53290 - DNA, 101 bp, rice(Oryza sativa)
  misc_feature (71): n=t or c
aaactgtaggaaacagtacaacttagatcccatggcagtatatacccccattttctcctattttcgctaantaggaaggtagcccgcgcatacgcgcgggc

SEQ ID NO: 53291 - DNA, 101 bp, rice(Oryza sativa)
  misc_feature (71): n=a or g
gattgatgaaccgttggtgttgattcgttgtcagatttttacttctttgtcatttcgatgtttctgttcgngtaatccaatccccatgttctgctcttgcc

SEQ ID NO: 53292 - DNA, 101 bp, rice(Oryza sativa)
  misc_feature (71): n=t or c
tccaggatactggaaaatgacatgtaatccccaggactaatcggggctgagaccacatttccccaattgcnggtcttggatgagtaaacgcagatgaacgc

SEQ ID NO: 53293 - DNA, 101 bp, rice(Oryza sativa)
  misc_feature (71): n=t or c
tcgcattcttacttttatttctacatggtacagtaggggatgtataaccagtaattgcttgttgtctgtanattaaaacaatctgacatagtagttaggtt

SEQ ID NO: 53294 - DNA, 101 bp, rice(Oryza sativa)
  misc_feature (71): n=a or c
atgtatgcagctacctggaaaaccatggttccaagctcaattgtggaaattttatggcttagatagcccantgttttcattttcggtgcttgagtaaccca

SEQ ID NO: 53295 - DNA, 101 bp, rice(Oryza sativa)
  misc_feature (71): n=t or c
ggtatcgactgttactcccactcaacgcccttccatgcaaggatctttttcaccatccaagaaccgacgtnggcgacgcaatgcttgtcgcacttgggttg

SEQ ID NO: 53296 - DNA, 101 bp, rice(Oryza sativa)
  misc_feature (71): n=a or g
tttgttgtgatgtgattaaaatcgcgtgcgctaatcggggtttgtaactttgtatacttgtttggtttgantcaatcgtcgtgtagtacgcagggttcccc

SEQ ID NO: 53297 - DNA, 101 bp, rice(Oryza sativa)
  misc_feature (71): n=t or c
cgtggccagctagagctggcgcaccggatactccggagcacggtcgctctcgaccgtctgatcatcgatcngacgcgcaaggttgaccacgatttcagaaa

SEQ ID NO: 53298 - DNA, 101 bp, rice(Oryza sativa)
  misc_feature (71): n=a or c
aattgtgttcatataagtactaaaacatcgcaaatgcaaactcatttgtacgtagtaccctgtagcttcgnggcgaggctgagtgctgagtgacgcgctct

SEQ ID NO: 53299 - DNA, 101 bp, rice(Oryza sativa)
  misc_feature (71): n=a or c
taggcttcacatagatgccaattgcatcaacataccacccagcacgaccaaagaatccaacaatgcatccnctgctctgtactgaaatgtggaaaggagtt

SEQ ID NO: 53300 - DNA, 101 bp, rice(Oryza sativa)
  misc_feature (71): n=a or g
atattgatcaccgacacaccttccccattgtaataatcactggtccgatgagatctgtccggttcaatccnctgcagctctgaagttatcagcgaatccat

SEQ ID NO: 53301 - DNA, 101 bp, rice(Oryza sativa)
  misc_feature (71): n=t or c
tgcttatgatcttttaccttgacagaagcctgtgctatccggagtacactatcctggtattcacctatgtncatcttcttcctctttaaggaacgataata

SEQ ID NO: 53302 - DNA, 101 bp, rice(Oryza sativa)
  misc_feature (71): n=a or c
gtagagcaaaacaggcactttagatagaaaacttcttgaaaccatatgaacccttgaaaacatagaacggnaaaagaattaatgcctaccactattataag

SEQ ID NO: 53303 - DNA, 101 bp, rice(Oryza sativa)
  misc_feature (71): n=t or c
ggtaatcaccctaaatagtgccagagaaagcatataaatatagcaatgcgagcatgtcctcaatctggcangacaagaataagttatatattattgaatgg

SEQ ID NO: 53304 - DNA, 101 bp, rice(Oryza sativa)
  misc_feature (71): n=a or c
accccgtcggcctcatcctcatgtaccccatgaataaggacatgtacgttcaattcgccgccgccattaangtgcatgtctcgagctcaaggagctcgtcc

SEQ ID NO: 53305 - DNA, 101 bp, rice(Oryza sativa)
  misc_feature (71): n=t or c
agctgggcagtggttcgacaccttgtacattcgtgaaactcgttggggccgtgaagacacgctctacctanatcgtgtttagtttcaaacttttttaaaaa

SEQ ID NO: 53306 - DNA, 101 bp, rice(Oryza sativa)
  misc_feature (71): n=a or g
tctcctctacctcatcatctaaatctttgttgcatttatgcttatagtacatgctcccggagcccaacccnattttgatcagtacatggcagcatttgtta

SEQ ID NO: 53307 - DNA, 101 bp, rice(Oryza sativa)
  misc_feature (71): n=t or c
atactcgccgtcgttttgcttcaagtaactgtgccctccttgcctttagcgaaaagaagggtgtcatccangtgttctgtgtcgacaagtagccatcattg

SEQ ID NO: 53308 - DNA, 101 bp, rice(Oryza sativa)
  misc_feature (71): n=a or g
tcatcattgtagttgattaccaatggtggttactgagaaatctcgcgtaagtctgtgttcttagttcagtntaaagtttagattttagttaaaattggaga

SEQ ID NO: 53309 - DNA, 101 bp, rice(Oryza sativa)
  misc_feature (71): n=a or g
gcccctgtgtgttgtgttttctgattttctatgcattcatacttgatgtgcactaaaatgactaaggattnctttcaaggaacattcaaacaaatattaga

SEQ ID NO: 53310 - DNA, 101 bp, rice(Oryza sativa)
  misc_feature (71): n=t or c
tccacccgtctttcaacaatcactcacatcgactgaccaacacattcacatccatataccaaacatggagngtaaaattgtctaaacaagcaatactaagt

SEQ ID NO: 53311 - DNA, 101 bp, rice(Oryza sativa)
  misc_feature (71): n=a or c
cagttttattagtcctaaaattgtaaaggatgagacatctgtggagaatagatcttttcccctagagttcnttgcccttctgccatcccacaccaccgtgg

SEQ ID NO: 53312 - DNA, 101 bp, rice(Oryza sativa)
  misc_feature (71): n=a or g
ttttgctgataaggtgcccaccgttccatttcctgctgcagttacttgcttagaattcaaattgccatttnctgactgcacagatgcttggggcttatcac

SEQ ID NO: 53313 - DNA, 101 bp, rice(Oryza sativa)
  misc_feature (71): n=t or c
attccaagtgctatggataaggcgatgcatttcgaagaaaaaaaatgagaggaagagacatccctccaaanattttttaagaagaaattatgagcgtgttc

SEQ ID NO: 53314 - DNA, 101 bp, rice(Oryza sativa)
  misc_feature (71): n=a or g
cacctggagcaacgaacaagataacccgaccctggtcaagctggatcgtttcttttgcaatgcaagctggnacacaacctttgagagacacctactgcatg

SEQ ID NO: 53315 - DNA, 101 bp, rice(Oryza sativa)
  misc_feature (71): n=t or g
gaccaactatgactctttcgtggaaattcgtggaaattccacggcaaaatatacagtctctaagtgcagtncacactttctgaaattctgaatcggattgt

SEQ ID NO: 53316 - DNA, 101 bp, rice(Oryza sativa)
  misc_feature (71): n=t or c
gctggtagcttttgctttgtacggagtagtactactagacttctagagctgaactagcagtaatagtttcnaaacctcagtagtctgttgatccgtcggcc

SEQ ID NO: 53317 - DNA, 101 bp, rice(Oryza sativa)
  misc_feature (71): n=a or g
ccaccagattttgtatttccgtgctttactatgtttgattctggaggtcttctattgttgcttctaagttntttggtggcctaatacacttaccaaattgt

SEQ ID NO: 53318 - DNA, 101 bp, rice(Oryza sativa)
  misc_feature (71): n=t or c
ttgctctatttcctttttgttatatgtggtcccttttatcaaactacttagttgtttaaacaggctctttnggctcaatgctcggtagagcagatggcgag

SEQ ID NO: 53319 - DNA, 101 bp, rice(Oryza sativa)
  misc_feature (71): n=a or g
acctgctgtgatagatcaccaatcacggctagttacttgactggtctttgaattgtcgacagcgacctacngagtactccctcgtcccacgaaaaaccaac

SEQ ID NO: 53320 - DNA, 101 bp, rice(Oryza sativa)
  misc_feature (71): n=t or g
aggtccacgtgcccatgtagagagcaccaagacgagctctatctatagggatgcacgagccagggtttaanttgggggtgaaaatggttggaaacaatcgg

SEQ ID NO: 53321 - DNA, 101 bp, rice(Oryza sativa)
  misc_feature (71): n=a or g
caacattgaagaggatgataagatggttcttgaggaggttgagtcaccgataaaaaatgacaataagacgnttcttgtggaggtggagtcaccagtgaaaa

SEQ ID NO: 53322 - DNA, 101 bp, rice(Oryza sativa)
  misc_feature (71): n=a or g
ggggtcaatcaaaagtctacaggatcatatgggatagtgacacataataagggtaatggtaccatacctcncttataggaagttctttcaccgttttgtca

SEQ ID NO: 53323 - DNA, 101 bp, rice(Oryza sativa)
  misc_feature (71): n=a or g
taacttgcgaccaaatgctcaacttgagctggccagacatgtctattgagacaaatgaggaagctaattcntctgatgagtggtacatgaagtattcctct

SEQ ID NO: 53324 - DNA, 101 bp, rice(Oryza sativa)
  misc_feature (71): n=a or g
gcccatacagattgctcactcaatttagctacacgcagagaaacacaagggaactgaagttaacttggctngtggaaatttattgtcttcctccctcataa

SEQ ID NO: 53325 - DNA, 101 bp, rice(Oryza sativa)
  misc_feature (71): n=a or g
tcagagcttgcttttttagttagggagatcaaatgtctcctaactggtagcagggagatagttgttgcgangatcgatcgtgctcaaaatagtactagtca

SEQ ID NO: 53326 - DNA, 101 bp, rice(Oryza sativa)
  misc_feature (71): n=a or c
gaccgtctaaaacttgacatagcatttcagtcaatcctaattagtgacctccctatgttttaaaaaaaatngttagcatgcatgctattttaagtgcagcc

SEQ ID NO: 53327 - DNA, 101 bp, rice(Oryza sativa)
  misc_feature (71): n=t or c
aggttaattgattggatgatcatttcgtcgaatataatgacaaatatgaactgagctatcgagaaccaaanacttccaacatttgcatagaacatatcgat

SEQ ID NO: 53328 - DNA, 101 bp, rice(Oryza sativa)
  misc_feature (71): n=a or g
attgagtaccttatggcaatatgctctggcaaccaaattgttgatgtgcttcacaaaaaaggcttgaatancaccattcttctcccttttaatgtactcca

SEQ ID NO: 53329 - DNA, 101 bp, rice(Oryza sativa)
  misc_feature (71): n=t or c
aacagtgtgtcgctgcttgtcattcagagcggcggttcagtgtccatcgaagaggctagaagagagatcangaagccgatcgagagatgcaggagagagct

SEQ ID NO: 53330 - DNA, 101 bp, rice(Oryza sativa)
  misc_feature (71): n=a or g
aagctaatgcagcttaattatgtgtttagctaagcagccagaagggaaaaaaaaaggtgtagcatgcattnacagtccaaatgatggacacaaggaaagta

SEQ ID NO: 53331 - DNA, 101 bp, rice(Oryza sativa)
  misc_feature (71): n=a or g
gcctagttgccgttccggcttaactgatcgcgtgaaaaaatccgctaatgattaattaagtactccatctntctcttaatataagagattttaacatttta

SEQ ID NO: 53332 - DNA, 101 bp, rice(Oryza sativa)
  misc_feature (71): n=a or g
gttagctctgagaaataaaagtgcagtcttgactctcgacgaatataagcaatttaacttgtgtactactnctgctgacaaatactggggaatataagcag

SEQ ID NO: 53333 - DNA, 101 bp, rice(Oryza sativa)
  misc_feature (71): n=t or c
aacctcctaaaagttctgcatgagtaccttttctccgttctagctgttatacctttggggactgctaatgngcgggtgatacctgcacccccctccccgtg

SEQ ID NO: 53334 - DNA, 101 bp, rice(Oryza sativa)
  misc_feature (71): n=a or g
gtttttttaagtggatttgtttttctttggaatctacattatcgcaggcggctgacgttactgtccacctngaggatggagggggggtgctcacatccgca

SEQ ID NO: 53335 - DNA, 101 bp, rice(Oryza sativa)
  misc_feature (71): n=t or c
atacctgctctaatactatgtggttcgcgttgatccgtactgtcatgcgaattaaccacaggaggaagaangtctaaggataaacgatgattcggtgcttt

SEQ ID NO: 53336 - DNA, 101 bp, rice(Oryza sativa)
  misc_feature (71): n=t or c
agaaaccctacgataatttgttccatggacgcgccgaatccgacgagatcagatgcaaccacgacgccggngacggcggacgacgacgccgccgtcgacta

SEQ ID NO: 53337 - DNA, 101 bp, rice(Oryza sativa)
  misc_feature (71): n=a or g
ctgctagtccagggactccggacgtagcaagcaagcacataagaatcccgttttgcagaaatagaacacgnaatgcgtttccaagaacaagacagatgtgg

SEQ ID NO: 53338 - DNA, 101 bp, rice(Oryza sativa)
  misc_feature (71): n=t or c
tgaggattcaagaccaccactaagcttttttcaagtagtagagattaattgatatcggcgtgaattcacanaatagtacaatatgaagaaatctatctatc

SEQ ID NO: 53339 - DNA, 101 bp, rice(Oryza sativa)
  misc_feature (71): n=t or c
tgtacactcaagacacgttgcacaataaggctctcatattggtctgcaacatcagccccgatgtgttcctnatcctcactacctttgttgttagctgcaag

SEQ ID NO: 53340 - DNA, 101 bp, rice(Oryza sativa)
  misc_feature (71): n=t or c
ttcgccgggcgttaacacaaattttgatgcactaccggcgttaacacaatttttgatgcactaccgcccanagcctaggttgtaaaagacacggtttgtga

SEQ ID NO: 53341 - DNA, 101 bp, rice(Oryza sativa)
  misc_feature (71): n=t or g
acaagctagtaacacaaacttctacgcaacgatttagctttgctcctctaagctttcgtgggccccacatntcatggactaacccgccgattccccacgtc

SEQ ID NO: 53342 - DNA, 101 bp, rice(Oryza sativa)
  misc_feature (71): n=t or g
atttaggacgaggtagtatatgatcaacatgattacggccaccggccatgcccatgctcattgattagtangagactcttcgtaggagcacgcacgtacta

SEQ ID NO: 53343 - DNA, 101 bp, rice(Oryza sativa)
  misc_feature (71): n=a or c
aatcatcagagagcagagacacctacattcatcaccattgtagcttctgtttcatcaagcaaaactgaagncatgaagactgtgaaccaaggcaagcagag

SEQ ID NO: 53344 - DNA, 101 bp, rice(Oryza sativa)
  misc_feature (71): n=a or g
caagacgattgctcgatgtagtaacctgatcttggtagacgatagcaccatccaaggtgaagttctttatnttgtgagcagaaaaaagaacgatgtctaat

SEQ ID NO: 53345 - DNA, 101 bp, rice(Oryza sativa)
  misc_feature (71): n=a or c
ccaatcaataaccactcactccatgtcttcatctgctttacagaatatgatggtagaaggcatgcccaagnagggtgcacgtagaacaaaattagggccca

SEQ ID NO: 53346 - DNA, 101 bp, rice(Oryza sativa)
  misc_feature (71): n=a or g
cgagtacaactccacgctgcaccagatctgtactaacctctccctctgcgacaaggttgtcacggatacgnagaagatcgagaagacactctccaccttcc

SEQ ID NO: 53347 - DNA, 101 bp, rice(Oryza sativa)
  misc_feature (71): n=a or g
acacatatatatatatacacacacacatacttgactaaccttgttccaaaaattctctcagtgaccatgcngcttttttcttcactcaagagccttgacaa

SEQ ID NO: 53348 - DNA, 101 bp, rice(Oryza sativa)
  misc_feature (71): n=t or c
ttatgtgtttgttgtgcaagttgctcatctatctgcacatccccttctgtctccctatgatcgaaatcatngcaagcatccacccttgggggaacaacctc

SEQ ID NO: 53349 - DNA, 101 bp, rice(Oryza sativa)
  misc_feature (71): n=t or c
agtttttctgagtgatagagaaccatcactaatgatgaactttatgtaggtcccagggaggttaaggatgnattttcattgttaaaagactgtgcagctga

SEQ ID NO: 53350 - DNA, 101 bp, rice(Oryza sativa)
  misc_feature (71): n=a or g
ggagatgaagaactcttaccactctctctcttttgatgtaaggcatggcctcctccagacagtaactcgcnacaaggatggggaacacaccgatgttggtg

SEQ ID NO: 53351 - DNA, 101 bp, rice(Oryza sativa)
  misc_feature (71): n=t or c
caatgtttcattagcagggagcaatgtcaatccactttctaaaccattagcagtggcaggtacagaaatancaattgtactgactcctgaaggaacttggt

SEQ ID NO: 53352 - DNA, 101 bp, rice(Oryza sativa)
  misc_feature (71): n=t or c
gatatactacacccagatgttgattttgtggaagcagagttggaagaactagatgagggaaatttgatggntatatctcaacaagctgttagtgggaccga

SEQ ID NO: 53353 - DNA, 101 bp, rice(Oryza sativa)
  misc_feature (71): n=t or c
agagatgaagctgaatttaatctacttcacaatttcactcaatacccaactacttagagttaagggcctgncaaaacttgaagcacaaccaaataatttta

SEQ ID NO: 53354 - DNA, 101 bp, rice(Oryza sativa)
  misc_feature (71): n=a or g
gaacttgacagaaacagaagtaaacctagacgacaatgttgttgcaaataatgataccaagagttcaggtnatatcaatgtggatgtatgtagcaatactg

SEQ ID NO: 53355 - DNA, 101 bp, rice(Oryza sativa)
  misc_feature (71): n=a or g
cacaggctccctacatatgatggccaatgagtacccacatgagtctttctttaggaagggagtcatcgganattgggtgaaccacgtcacgccagagatgg

SEQ ID NO: 53356 - DNA, 101 bp, rice(Oryza sativa)
  misc_feature (71): n=a or g
ggactcacacccgcggtcacacattggtgcacatatgagactgtatggaagaacgacgacgaggtttcctntgaagaacgacgacgccgggagggagacga

SEQ ID NO: 53357 - DNA, 101 bp, rice(Oryza sativa)
  misc_feature (71): n=t or c
ttgccttggtgcattccgtcggctacttcagaggtctcagtatcaagttcaatatggacgtcctattcagntacttatcctagcaattgttgttttactag

SEQ ID NO: 53358 - DNA, 101 bp, rice(Oryza sativa)
  misc_feature (71): n=t or c
acgtactactggttgtaggagtacaaatattccctgacctcggtcaaaaactgcatcacagagcaggatantcttctttgactcacatttcttaagagcat

SEQ ID NO: 53359 - DNA, 101 bp, rice(Oryza sativa)
  misc_feature (71): n=a or c
tatccttgttcacaatttgccccgagcagctttcatacaagttaagcacattttgcagacactgtgcactnctttcattaactttaaagagtagcagcgaa

SEQ ID NO: 53360 - DNA, 101 bp, rice(Oryza sativa)
  misc_feature (71): n=t or c
ttttcttattctttttttcaatctttgtgttccgaatgagccctcatttgtaaaaaaaaaaacaaaggganagaactatttgaccataaaacataatttca

SEQ ID NO: 53361 - DNA, 101 bp, rice(Oryza sativa)
  misc_feature (71): n=a or c
ctatgtttgagtatgtctgtcgattaggaggtagcaactcctccatactaagggcaagaggagtcatggtnagtgcatatgtggttattagttaaggatat

SEQ ID NO: 53362 - DNA, 101 bp, rice(Oryza sativa)
  misc_feature (71): n=t or c
tgccgtagtcagcgtggagacgacggtgcggccgcctctcacgttttcacttaatccctccctgatactanggcggcggcggccgtgtcgtgggtgtgccc

SEQ ID NO: 53363 - DNA, 101 bp, rice(Oryza sativa)
  misc_feature (71): n=a or g
gaactatcagaattatacagttacacaccatcagaaaatcctcctcgttacctcatgctctcgagggcgancttctggacgccgggatcggggtcctgcgc

SEQ ID NO: 53364 - DNA, 101 bp, rice(Oryza sativa)
  misc_feature (71): n=a or c
gattatcatcagttggatccctgaatcagtaaaacttcaatattctgacattactcgttgccttgcttganatatatgcagcatttcgtatctactcccaa

SEQ ID NO: 53365 - DNA, 101 bp, rice(Oryza sativa)
  misc_feature (71): n=a or g
gtatatgattacgtcattttcgtattatgtaatatttgatcttgttttgcccattcttactatacaattcntcttttgccctttctgcactatttaacagg

SEQ ID NO: 53366 - DNA, 101 bp, rice(Oryza sativa)
  misc_feature (71): n=t or g
gagatatgagcaagactccaaaatgaaacttgtgcatgattccatgaattatctccaggatttattgcatntttttggagatcatttccacaagttttgtg

SEQ ID NO: 53367 - DNA, 101 bp, rice(Oryza sativa)
  misc_feature (71): n=t or c
gcgtcacggtcgtcttggtttatccccagcctccttgcaatctgttccctgatgtttcttgaggccgtganaaaaatgacaaactgaaagtcagaatgttc

SEQ ID NO: 53368 - DNA, 101 bp, rice(Oryza sativa)
  misc_feature (71): n=a or g
attggttaggttagtgcatattgtgtgatggtaggccataggcactaggcagcggcacggcatagaaaatncagaaatatgtaaagtatttttggcacgaa

SEQ ID NO: 53369 - DNA, 101 bp, rice(Oryza sativa)
  misc_feature (71): n=a or g
caagccattggtccacatgaattgaaatatgccaaggtgatcgtggaaatcatcgaacagagcatttcctncctgcaaaaacatgtcattacatacaaaga

SEQ ID NO: 53370 - DNA, 101 bp, rice(Oryza sativa)
  misc_feature (71): n=t or c
agatgggatctagggaggtcggggtcatgctacaaccactcgaatcctacagctctacagagtccaatccnggcaaatccaagatcggatctagggaggtc

SEQ ID NO: 53371 - DNA, 101 bp, rice(Oryza sativa)
  misc_feature (71): n=t or c
cgccgccgctcctcctccgtcaccagatccgtagtcctccctatcgctggatccaccgctgcagtcctccncatcgctagatccgccaccaccgtcctccc

SEQ ID NO: 53372 - DNA, 101 bp, rice(Oryza sativa)
  misc_feature (71): n=t or c
ttttctttctttttgagaggaaaaaaaatattttccgaaaaaaaattaccgttcgcgcgcgcggggtcagnctgtcgtgtggattaggaaagcgcgggaga

SEQ ID NO: 53373 - DNA, 101 bp, rice(Oryza sativa)
  misc_feature (71): n=a or g
tatttggatccagaaactactacataacatcctatcctatcttagtgtaagttataactcactagatcctnaagcttaacatacaacgatgctatattatc

SEQ ID NO: 53374 - DNA, 101 bp, rice(Oryza sativa)
  misc_feature (71): n=t or g
atggaaatggcatactggattgcaaggagtttgtgacagtatccattcacctgaagaaaatccgtagcgangagcaccttccgaaggtgttcagcttcttc

SEQ ID NO: 53375 - DNA, 101 bp, rice(Oryza sativa)
  misc_feature (71): n=a or g
ctgcagaaacattagtgtatcatagtccaagtctgtcggcaacatctctggtgccagcacagtgccattanggtactgcaggacttgccgcatgctcggcc

SEQ ID NO: 53376 - DNA, 101 bp, rice(Oryza sativa)
  misc_feature (71): n=a or g
tagtggcattcatgtaattctttgtctcgcatgtcccaatctctgcccacttctaatcactaagctaattntaatcgccccactaatcacccctactaatc

SEQ ID NO: 53377 - DNA, 101 bp, rice(Oryza sativa)
  misc_feature (71): n=t or c
ttttcgccactagtcagacgcccgatacctagctgcgtccaatgttttagaaaggttttcttcatggaaantgtagtcatcagatttattgtaggaaagca

SEQ ID NO: 53378 - DNA, 101 bp, rice(Oryza sativa)
  misc_feature (71): n=t or c
cacctcttttcccccaccagcccatcctcctccccacccctttacgtacgtacgttgcttcccccctcccnccttccatatcttctcctctattttcgcct

SEQ ID NO: 53379 - DNA, 101 bp, rice(Oryza sativa)
  misc_feature (71): n=t or g
atgtcgtcttaaaataagttcatctctagccactctcattcatctccttctgcctccagcatggcgatcantattcctggttcgttccatcgctcaaccgc

SEQ ID NO: 53380 - DNA, 101 bp, rice(Oryza sativa)
  misc_feature (71): n=a or g
tatggtcgacacggtatatacgattctctgatacgagtgatggggtgattagtccttatatttatacaccntatgtagggagagccctgacctgccatcat

SEQ ID NO: 53381 - DNA, 101 bp, rice(Oryza sativa)
  misc_feature (71): n=t or c
tctcctcctagctcgaccaggtcgagccgtgtttcgtcagatggtgaaacaacatcgtggagtacaagacngaatgtctcatcttgtaaatcgaagcggag

SEQ ID NO: 53382 - DNA, 101 bp, rice(Oryza sativa)
  misc_feature (71): n=a or c
tatgggcctccaaagaatcacccaaaaactccataagtccacaaacatttggcccacttccccgtcacacntctcctaaaatccccttcccttgaagcgcc

SEQ ID NO: 53383 - DNA, 101 bp, rice(Oryza sativa)
  misc_feature (71): n=t or c
tagtgattgtgtaccatggatgcaatgaagccgtagctcagtgcaattatgccgttttccttgatatgtantgacttcacttggcaaagctcagtccacac

SEQ ID NO: 53384 - DNA, 101 bp, rice(Oryza sativa)
  misc_feature (71): n=t or c
tccttctctattcaatgaaattggcgctcattgattcgttcaaaaaaaaggttgatgtgatggaaaaagantgaagtttggatccaaattttggatctaaa

SEQ ID NO: 53385 - DNA, 101 bp, rice(Oryza sativa)
  misc_feature (71): n=t or c
tcccaccgccgccagccatcaccccctctcgcacagcctcaacaaacgaacgacgaaaagtagggttttgngacggtcagaccggcggcggcgacaggtgc

SEQ ID NO: 53386 - DNA, 101 bp, rice(Oryza sativa)
  misc_feature (71): n=a or c
tttagtaaagttcaatcaatatgttttttcatatgcatttagccaagacctgaaaagcataatcatgtacncttgagactacagagaatgccattggcaat

SEQ ID NO: 53387 - DNA, 101 bp, rice(Oryza sativa)
  misc_feature (71): n=a or c
aacctatttttgcaaatggctggatggcccacctccccttcaggtatttgtaataatccacattttcccanacaggtgtcacaattgcacgtgaaaaatcc

SEQ ID NO: 53388 - DNA, 101 bp, rice(Oryza sativa)
  misc_feature (71): n=t or c
catgatgaggataacaaacacaagtgtcaccaacagaagggacacaataattaaacaagccatgtgaaagnatgctttgtactactactattactactaca

SEQ ID NO: 53389 - DNA, 101 bp, rice(Oryza sativa)
  misc_feature (71): n=a or g
gtggttccatatctttccgcactatgatcagggaagaccaacttcagcaggatggtgttgatgaaattggnttctcctctcgtagtggtgctcatattgga

SEQ ID NO: 53390 - DNA, 101 bp, rice(Oryza sativa)
  misc_feature (71): n=t or c
aaaggtaaagcttttgctccaagaaaaaaggatcatcttatcttcccagatgacgtgtgtacaggttcatncttagaattgaacttttttttttaggatag

SEQ ID NO: 53391 - DNA, 101 bp, rice(Oryza sativa)
  misc_feature (71): n=a or g
agaaaccttggtagagattcaatgtaccaatctcccagaaagagcacaactttgtggtagcctccacgttntgcttggtgggcaacggggaatcagtgctt

SEQ ID NO: 53392 - DNA, 101 bp, rice(Oryza sativa)
  misc_feature (71): n=a or c
acgttcagtttactatctggccagtccatggtgacctcatcacaacaattaagacctggatggagccaatntaccgaaatggtaagctctcaggaaccatc

SEQ ID NO: 53393 - DNA, 101 bp, rice(Oryza sativa)
  misc_feature (71): n=a or g
gtgtgggtgaactccatgcgcatcccacacctctccatattggaccttagagtggtgaccatggaacctcnggacctagacgtccttgcgaggatgccgga

SEQ ID NO: 53394 - DNA, 101 bp, rice(Oryza sativa)
  misc_feature (71): n=t or c
gtccagcaaattgtaccgctcagtactggtaccgctcggtaccagtacgcatgtaccgttcgttctggcangggtaggatcggaagagagtggcgccggcc

SEQ ID NO: 53395 - DNA, 101 bp, rice(Oryza sativa)
  misc_feature (71): n=t or c
gatccaacggctcgtcggtcaccaccaaggacataagcgacgagcagcccccattaggctgtgtttagttnctgaaaaaagttgaaagtttgggaaaaatt

SEQ ID NO: 53396 - DNA, 101 bp, rice(Oryza sativa)
  misc_feature (71): n=a or g
gtcttctgaaactttagtagtatgcatacctgcttctgttgacaaattagtatggtcatcgtcacaagttnttccatgttcttctgggacatcaatttctt

SEQ ID NO: 53397 - DNA, 101 bp, rice(Oryza sativa)
  misc_feature (71): n=a or g
caaaattcgttccaaaatatcaaggattttcgtgttgatctcagtgttcaaactataccacggactcaacnatatcatcgcgttctatataaaccttgtga

SEQ ID NO: 53398 - DNA, 101 bp, rice(Oryza sativa)
  misc_feature (71): n=t or c
gccattgtctgaaaatggtttcccaatgcaatacttgtcaatgcctattgccagattgtccctgccactgngtcgaacaccttcggtgcaagttggtgcgg

SEQ ID NO: 53399 - DNA, 101 bp, rice(Oryza sativa)
  misc_feature (71): n=t or c
aaaattatggataaactgtgctacttcaattctttgcttttgatcaaatgacagcccttgctctttccaanaactctattgacaaagatgttaaacatatt

SEQ ID NO: 53400 - DNA, 101 bp, rice(Oryza sativa)
  misc_feature (71): n=a or g
gcatgcttaacttgctctggttttgatttggccacagggtgaagaggctccggagtttcgtgtcgagagcntcgccttggaatccaaggactgcctgcaga

SEQ ID NO: 53401 - DNA, 101 bp, rice(Oryza sativa)
  misc_feature (71): n=t or c
ctgcgaacgttccagcgccgtgtgcagcggagatgaatgggagggtggctcatcaacaatgccatggaacngcatcacaggcgaagttccacttgcagctg

SEQ ID NO: 53402 - DNA, 101 bp, rice(Oryza sativa)
  misc_feature (71): n=a or g
ggagctttggatgatgacgacgacgacgacgagttcgtcgtaatgggatgtcttcgctatcttttggatcnctgcatggcatttgttggggtttagaactt

SEQ ID NO: 53403 - DNA, 101 bp, rice(Oryza sativa)
  misc_feature (71): n=a or c
gagggcgtccatcaccttcgacaatgtcaccaggatgctggtcgccaccgtgcagtttactgatcagactnctgcttcgcgtgctgcccctgttcaggtga

SEQ ID NO: 53404 - DNA, 101 bp, rice(Oryza sativa)
  misc_feature (71): n=a or g
cttggaaagagacatgaagatgaaaacacaggctggggatctgacattttattaccaatggggcacgctantaagtatcccattcagcaactaggcagtac

SEQ ID NO: 53405 - DNA, 101 bp, rice(Oryza sativa)
  misc_feature (71): n=a or g
taaagaatcttataatagtgtacatagacacgtaatttgcaggggaatatagctagacaaatcacaccacntgtcaaacttggtagacactatagtctttg

SEQ ID NO: 53406 - DNA, 101 bp, rice(Oryza sativa)
  misc_feature (71): n=t or c
tacctactagagatgtggtggaaaccatacaagtaaaggagatcaaagccgacaccgtgattgtcaaaagnggaggtctgaccgaggcgtctagccggtca

SEQ ID NO: 53407 - DNA, 101 bp, rice(Oryza sativa)
  misc_feature (71): n=a or g
aaagctctggaaatctcaaatcatagcaaacagtaagcccaagtcgtccaaaaggactatccactgcaacnacagtatcacctgataaataaataaataca

SEQ ID NO: 53408 - DNA, 101 bp, rice(Oryza sativa)
  misc_feature (71): n=a or g
atgctcatgaatgactaggtcaagtaatgggacgagaagaagaaatggtgaagcacaggcaaacccaagcngtagaagagaacaaacaggcacaagccatg

SEQ ID NO: 53409 - DNA, 101 bp, rice(Oryza sativa)
  misc_feature (71): n=t or g
agcgagcatgcagctccccctctggtcaatagagtactaagaacacgtaccttgtcctcaccatggccgcncagcaaagttaagcttggtttttactctag

SEQ ID NO: 53410 - DNA, 101 bp, rice(Oryza sativa)
  misc_feature (71): n=a or g
agactcaatgtgagcagaggagttgtctgggtcactgaaaacgtgctgggggaggatgtatttttcttcanctgaacccatctgatgaaatcccaagtgac

SEQ ID NO: 53411 - DNA, 101 bp, rice(Oryza sativa)
  misc_feature (71): n=a or g
cggctgaggatctgacctctacaatgccaagacaagaatggagttcaggatatctgttaattgtccctcanaactactgaagtcaatgtttgtcagggtta

SEQ ID NO: 53412 - DNA, 101 bp, rice(Oryza sativa)
  misc_feature (71): n=a or g
gtgagaattgaaggacggttaattgggagaaggtatataatgatgacctgacagcaagaggaacatgtacntcttctgtataaatgcttgagagaatcatc

SEQ ID NO: 53413 - DNA, 101 bp, rice(Oryza sativa)
  misc_feature (71): n=a or c
gcacgcggaatttgatctgccacttgaaccctgggaaattctctgctacatcctgggggagctcaagcctngatcccagcccgtacaagcacaaggcagca

SEQ ID NO: 53414 - DNA, 101 bp, rice(Oryza sativa)
  misc_feature (71): n=t or c
gtgaagccgcatctcaagaaacttgacgatcgcaacaaggtgatggtttttctcggctatgagccaggaangaagggctaccgtgtcttcgacccggaggc

SEQ ID NO: 53415 - DNA, 101 bp, rice(Oryza sativa)
  misc_feature (71): n=a or g
acagatacgccatcgctcctccaaaaatagcgcatacgccaaaacggcaaagagagaaagggcaaatatancgtgtctctctcctcacgccataccacatc

SEQ ID NO: 53416 - DNA, 101 bp, rice(Oryza sativa)
  misc_feature (71): n=a or c
tctgaagcaaatttacaagatggacctctctagcaaccactttcttgggagcctgccagattcaattgggnaaattcagatgataacctacttgaacctat

SEQ ID NO: 53417 - DNA, 101 bp, rice(Oryza sativa)
  misc_feature (71): n=t or c
tcgcttgtactaatggtttgctagacgagttagaaggagagagaactgaaaactgtggtgaaatatgtttntttgccatctgaaaattcccatgacattag

SEQ ID NO: 53418 - DNA, 101 bp, rice(Oryza sativa)
  misc_feature (71): n=a or g
gacactaaagataaggctcgaagactccaaatgccatctggaccattgattgacatcactaattacatcgntacacattctgttaatactgactacctggc

SEQ ID NO: 53419 - DNA, 101 bp, rice(Oryza sativa)
  misc_feature (71): n=t or c
atccctagtattgtcatatgaagaatcatcgacaaccgcatacttgcaaatgtggaacagggcgtgagcantacagatcaggaattcctcttcattagcct

SEQ ID NO: 53420 - DNA, 101 bp, rice(Oryza sativa)
  misc_feature (71): n=a or g
catgtaaaaactattatactgtaggtatgttcggtggtgcttgctgctgctgttgcgacagctgaaaaacngctacaggcaacagcagctaaaaacggcca

SEQ ID NO: 53421 - DNA, 101 bp, rice(Oryza sativa)
  misc_feature (71): n=t or c
cctgtgacggatgactctttccaactcatcaaaggtgacaaaacagctgtgactggttttaattcccaccngtcacagatgtcaaaaaccacccagaaaaa

SEQ ID NO: 53422 - DNA, 101 bp, rice(Oryza sativa)
  misc_feature (71): n=t or g
gcagaaaccaggaaatggttgggcacaaaggtctggcctctggaaaatggtaacaggaaattatcatattnttgtaaccctgttggaaaaggtagagaagg

SEQ ID NO: 53423 - DNA, 101 bp, rice(Oryza sativa)
  misc_feature (71): n=a or c
cggttggtttaagtgtatctctccatagaggacggacaaccataatcaatttctctttttcagtatggccntggaaagtttttaaatatgatttgacagac

SEQ ID NO: 53424 - DNA, 101 bp, rice(Oryza sativa)
  misc_feature (71): n=t or g
tttattgcagtaaatagctgatatgaatacagtgtcatattgccaggagttaccaataaatcagcggttgnggtaggttcaggttcatcatcaacctcagc

SEQ ID NO: 53425 - DNA, 101 bp, rice(Oryza sativa)
  misc_feature (71): n=a or g
tttgctcgtgggatggtgtaacttgcatctataggtgaaatatctgtcaggagatagcatttctctaggcntctagtgtttctagtttgtacaggtgctca

SEQ ID NO: 53426 - DNA, 101 bp, rice(Oryza sativa)
  misc_feature (71): n=t or g
aagttgattcttgaactgacccctgatcatgaggatacactgatttagaacagaggataaagattaagaanaagtggaagaagaatacttaaatgtgaagc

SEQ ID NO: 53427 - DNA, 101 bp, rice(Oryza sativa)
  misc_feature (71): n=a or c
gccttaccgacgatggttttgtcaccatgtttaaatgtcacttgcccattaggatcctgaaaaggtcaaanagagcacagcttaacttagtattcgagaga

SEQ ID NO: 53428 - DNA, 101 bp, rice(Oryza sativa)
  misc_feature (71): n=a or c
aactttccaggggatatggatgggcatgttgacaggaacattactccagatggccatactatttttcattntcatgagaacaaagtgggaggcacaggtac

SEQ ID NO: 53429 - DNA, 101 bp, rice(Oryza sativa)
  misc_feature (71): n=t or c
cgcggcgaacatgtcctccggtatctcgccggagatgtggttcatcgagatgtccagttgctggagcttcntgaggccgcccaaccccgccggaatcctgc

SEQ ID NO: 53430 - DNA, 101 bp, rice(Oryza sativa)
  misc_feature (71): n=a or g
accgctgccacacatcctcctcgcccccacaacactgcttttgcccgctgccttcgctccaccatcgcctntagtcttggagcgaagccgccatgcgccgt

SEQ ID NO: 53431 - DNA, 101 bp, rice(Oryza sativa)
  misc_feature (71): n=a or g
gccggtgatacaaagaggtgcttggagattgcttgtgacatactggagaagaaggaattggctgcaccagncaaggtggccgaagcatatgtggaggtatc

SEQ ID NO: 53432 - DNA, 101 bp, rice(Oryza sativa)
  misc_feature (71): n=a or g
attacagggttccatggcccatttgctagctgtgcccattggaaggattgttttcaagttcattttacctnttgcttaattagtttacatattagcaatca

SEQ ID NO: 53433 - DNA, 101 bp, rice(Oryza sativa)
  misc_feature (71): n=a or g
aatttcaggtcccatggctgccacatcatcaaccaaggtggcactgagagcgttaaaggatgggatttgtnccttaccccagcgggcacttagatggagcc

SEQ ID NO: 53434 - DNA, 101 bp, rice(Oryza sativa)
  misc_feature (71): n=t or g
ttgatgctaacagaagcaaactgcatgtatgcaatagtaatgaggaagtttcggaacttgtaacttctatngagatggatatttcttaggacagtccatat

SEQ ID NO: 53435 - DNA, 101 bp, rice(Oryza sativa)
  misc_feature (71): n=t or g
cttgaagagattagaaggggcccctcactgatgatagcatcgctgcccaaaaggagttgttgatccgcctngaactcctaatggagcaggaggaactgatt

SEQ ID NO: 53436 - DNA, 101 bp, rice(Oryza sativa)
  misc_feature (71): n=t or g
caaattgcttgtgggatttccccagagaaactattgtagctcaaatcaagcatatcgagtgccttcagctnaccaatctctggagggatcacacctgtaaa

SEQ ID NO: 53437 - DNA, 101 bp, rice(Oryza sativa)
  misc_feature (71): n=t or c
ggcaccggtgactaaaagggggaaggtagccacgtcggtgccgttgaccaaaacggggaaggtcgtgaagntgccagcaacatttgaattaggcatgccat

SEQ ID NO: 53438 - DNA, 101 bp, rice(Oryza sativa)
  misc_feature (71): n=t or g
tgggcttgctgtggcccagcctaatgctttggttccatatcagatgcccattcatcatgttcttcactttnctcttctggcctctgcgctcatctgggcta

SEQ ID NO: 53439 - DNA, 101 bp, rice(Oryza sativa)
  misc_feature (71): n=a or g
gttaattaattaatggtggttggtctttaaaatttgtacttcaactaaatgatacgccgcgtcttgctgcngcatatgtagttgaaaggtgaagaactcaa

SEQ ID NO: 53440 - DNA, 101 bp, rice(Oryza sativa)
  misc_feature (71): n=t or c
agaggtggcagcaggtaatactgatagagtacttgtaagggcatcagcaatcaaagatactctatgggtgncctcactaaccgaagctactctatgggaca

SEQ ID NO: 53441 - DNA, 101 bp, rice(Oryza sativa)
  misc_feature (71): n=a or g
ttaatttacatgggaattggatggaagtgtgcagaggatcataccataaatatacttgtcaagactccctntaggcaaatactcgtagcagagtaactttt

SEQ ID NO: 53442 - DNA, 101 bp, rice(Oryza sativa)
  misc_feature (71): n=a or g
agcttaccttggggagaagctagtattcaaaacaggagcattcccaaatcttagaacactttcgatttacnatttggatcagctaagagagattagatttg

SEQ ID NO: 53443 - DNA, 101 bp, rice(Oryza sativa)
  misc_feature (71): n=t or c
aaaaacaaatcacacaaacgttgaggttattcggtagtgcttaactgcggctatgcagccgcagcattgcngtttctcctatatctttcttgtggttggac

SEQ ID NO: 53444 - DNA, 101 bp, rice(Oryza sativa)
  misc_feature (71): n=t or c
taggatgtaatatggatgatctgttagagtgaaaagttatatagggtgagaatctttttatatggctatcnaaataggagtatggaggatgaaatttagat

SEQ ID NO: 53445 - DNA, 101 bp, rice(Oryza sativa)
  misc_feature (71): n=a or g
gtgccgtttcggcgagcgccaagtctaatacttggggcacaccgtctccgccgaaggagtagccatggatnaactcaaggtccaggccattggtgcgtggc

SEQ ID NO: 53446 - DNA, 101 bp, rice(Oryza sativa)
  misc_feature (71): n=t or c
cctgaccaacttcacacatcaaacaaacaagaccagcaatagtcttctcgcttctgttggcaagagctggnagaagaagagcttctctaatatatggcatt

SEQ ID NO: 53447 - DNA, 101 bp, rice(Oryza sativa)
  misc_feature (71): n=a or g
taatcatgacaactaatcactaattaattatttttcaaaacggtgtcgctgtttggcagtgcgagaccgcncgatctcgcgttagaccgagcggtcttgct

SEQ ID NO: 53448 - DNA, 101 bp, rice(Oryza sativa)
  misc_feature (71): n=t or c
tagccatcacctctattatatttatagccgttgatcatttacaatttcagcaagggaaggtgattcagagncattgtatttactcggaactggggtgttcc

SEQ ID NO: 53449 - DNA, 101 bp, rice(Oryza sativa)
  misc_feature (71): n=t or g
gtggatttatctcatcatatgttcattcatgcttttcctgctatataatacaaacattgcctttttagccnatgcttattacttcttaatctttctttcca

SEQ ID NO: 53450 - DNA, 101 bp, rice(Oryza sativa)
  misc_feature (71): n=t or c
tccaactcgatgttccagatgttggaaggctctcaacatacccagttctcacctcttcagtcttctggttnatcctgagcttgcagagagtgaccagcagc

SEQ ID NO: 53451 - DNA, 101 bp, rice(Oryza sativa)
  misc_feature (71): n=t or g
cctgctgctgctgctttgcccgttcgtgcagcacgtaacatcatcctcacaaagacaaagatgggttccanggacgatggatcatgatcgattgatcatag

SEQ ID NO: 53452 - DNA, 101 bp, rice(Oryza sativa)
  misc_feature (71): n=a or g
acaaggagttagcagacaagaactcaaagaaaacacactttactcaaaggcattcctcataaaccgcaccncaagtcctcttgcttggtaagaatgctagc

SEQ ID NO: 53453 - DNA, 101 bp, rice(Oryza sativa)
  misc_feature (71): n=a or g
actgatcctgatatagttacgcgtgtgccttgccattgcatgtggtgagccgatgatgaggacgataccangtcgatcaggttttgcatcatctccgccgc

SEQ ID NO: 53454 - DNA, 101 bp, rice(Oryza sativa)
  misc_feature (71): n=a or g
cactcaccgtgcttaattttgaaccattatggctattgtgtgcaggaggtgatcaatggcgagcggcggcncattatccccggtggaggagaagcccacgg

SEQ ID NO: 53455 - DNA, 101 bp, rice(Oryza sativa)
  misc_feature (71): n=a or g
gcatgtttttactcaaatgcctgaccatatcacttattgcagccattagtgcagtagaagattgagctttngagtgctcggcaaggcgtgttgtgacctca

SEQ ID NO: 53456 - DNA, 101 bp, rice(Oryza sativa)
  misc_feature (71): n=a or g
ttatttttcatcttcatctttatgagattcaaacaccaccgcaatcttctttgctttgcttcatggttccnaaatagcgacgcaatatctccgctcctctt

SEQ ID NO: 53457 - DNA, 101 bp, rice(Oryza sativa)
  misc_feature (71): n=a or g
ttcttagaggtagcagaagacagctactactgtggcgacgaagacgactattgtgatcggggctggagtgnccgtggacttgggtgatgaaccagatctgt

SEQ ID NO: 53458 - DNA, 101 bp, rice(Oryza sativa)
  misc_feature (71): n=a or g
tctgctttttaaagcttggttttgcgatgactcacctctagttggagaagaaaacgaaatagataacatanaaggaaaaaaaagattgatgagaggagagc

SEQ ID NO: 53459 - DNA, 101 bp, rice(Oryza sativa)
  misc_feature (71): n=a or g
ttccatattttcctttatcttttatttttttgcatgtgcttatagttggtttaagcctaactagatgggangcccgcgcaattgcgcggctagcacccata

SEQ ID NO: 53460 - DNA, 101 bp, rice(Oryza sativa)
  misc_feature (71): n=a or c
gctgtagctatattttatgaaggatggaggtaatagattcttaactgattgccctttgttagatttggtcntgttttctaccatgcatataaccaactttt

SEQ ID NO: 53461 - DNA, 101 bp, rice(Oryza sativa)
  misc_feature (71): n=a or g
cgacaaggatgtctcatatgagatggaatctgaagctacagaatttgtgctgaatttgcttggaatcaatnatggtatctcaccatcactgacttctcttg

SEQ ID NO: 53462 - DNA, 101 bp, rice(Oryza sativa)
  misc_feature (71): n=a or g
aaagcttgactctgagctcaggaggaagaagatggaagggcacaagagtggcatggaagctgtagcagttnccatccctcccttgcacactggtgagagca

SEQ ID NO: 53463 - DNA, 101 bp, rice(Oryza sativa)
  misc_feature (71): n=a or g
gagtgacagaatggagtgggtatgcaaggattcgtgtagtattcagccatgtcaaataattgacgggcctngaccctggactttacaagatattaacaatc

SEQ ID NO: 53464 - DNA, 101 bp, rice(Oryza sativa)
  misc_feature (71): n=a or g
ggtttttggcctgcttcggtttcttgcactaaagctgcgctgacagcgacgagcgaagctgctagataganccacagttcgtttcctgccgctgggctgac

SEQ ID NO: 53465 - DNA, 101 bp, rice(Oryza sativa)
  misc_feature (71): n=t or c
cgagacagtataaattgctctatatctaaacatgctccaaagtaggggttatgcatgctcacagcatagcngatagggtagacctaacctgtatcagctag

SEQ ID NO: 53466 - DNA, 101 bp, rice(Oryza sativa)
  misc_feature (71): n=t or c
gagggaggtgcgggtgaatcagagaggaggtgtggagccgttggatgtaactcatcctgtgaatttggatngttggatgtgtgatatgataaatgatgaat

SEQ ID NO: 53467 - DNA, 101 bp, rice(Oryza sativa)
  misc_feature (71): n=t or c
ggaaacgaggtgttcaaacaacaacctgaactgactggtatgcttgtctcggccatgcaaaatgtgcaaanggcgttagcgaacctgaacctggcggatgg

SEQ ID NO: 53468 - DNA, 101 bp, rice(Oryza sativa)
  misc_feature (71): n=a or g
tagcaagacaaatcattaaataaaatgaaaacgtactactgtacaaaatcacagtaaaaacacaacaaacncaaaagaaaacgaaataagaaaatactttc

SEQ ID NO: 53469 - DNA, 101 bp, rice(Oryza sativa)
  misc_feature (71): n=a or g
aatggcattgccctatagcagccaaacgatcgaggtcctcaaaagcaatatacgcaaatttatgtcatccnattaagattataagagtatagcgcaactac

SEQ ID NO: 53470 - DNA, 101 bp, rice(Oryza sativa)
  misc_feature (71): n=t or c
gcaggagtgcgccatcgacagcaaggaactggcgcgcctccacatgcgataccttgccagtggtgcggaangccaccgcatcaactactatgagcaagatt

SEQ ID NO: 53471 - DNA, 101 bp, rice(Oryza sativa)
  misc_feature (71): n=a or g
acacggaccgaaacggaaggagtacgctgggcgcaaggcagcagcaggggcggggttgacactacacttgnggggctggacggagatcgatgcgcggcagg

SEQ ID NO: 53472 - DNA, 101 bp, rice(Oryza sativa)
  misc_feature (71): n=a or c
atatttttaaaagttgactttgggtcctttgatagtagtttgtattatattctaacattcgtactccctcnatctcacaatataagggattttgagttttt

SEQ ID NO: 53473 - DNA, 101 bp, rice(Oryza sativa)
  misc_feature (71): n=a or g
gcatgaagctcgttgatgctactggatccagcctccccatcgctagattatatttgacctcctcgccactngatttggggccatgatggccgctccgctcg

SEQ ID NO: 53474 - DNA, 101 bp, rice(Oryza sativa)
  misc_feature (71): n=a or g
aatgaaaatggtactctcccctaacattccgtaactatttacacccaagccctttagtccaaaaacaacangaactattcatgcttcatgcacagttcacc

SEQ ID NO: 53475 - DNA, 101 bp, rice(Oryza sativa)
  misc_feature (71): n=a or g
ttggaattccacccaccgaaaacccgcatcagcagttaaaaatagtgatgcgggtttccaccacggaatcngaaagcgacggcgaagaagacgacgacatg

SEQ ID NO: 53476 - DNA, 101 bp, rice(Oryza sativa)
  misc_feature (71): n=a or g
tgatgttgtcaagtttaataccggcaaaatcagatccaagagatagaggcattccagtggcgatttaagtnaagatttctatatttacccaaacatatgta

SEQ ID NO: 53477 - DNA, 101 bp, rice(Oryza sativa)
  misc_feature (71): n=a or g
gaataacatatggacaaggtagcagaatacttcgatcataggagcatttggttggtctcaaagtcttatcncaaaaatgtacaggagtacaacaatgtgtc

SEQ ID NO: 53478 - DNA, 101 bp, rice(Oryza sativa)
  misc_feature (71): n=t or c
cacaaatggcatcatgaaaagtcaacaggaattcagacaaatcaatggtagtacttgactagagagcttanccacacgcaatagtgtctattctgaaaatt

SEQ ID NO: 53479 - DNA, 101 bp, rice(Oryza sativa)
  misc_feature (71): n=a or g
ccgcgtctccaccggatgtctatatggccggagctgcctctctgatagtgcagattttcacttccgcggcntacttctggaggaaatggacgatcgagttc

SEQ ID NO: 53480 - DNA, 101 bp, rice(Oryza sativa)
  misc_feature (71): n=a or g
ataagttttactattgcatctgcttctcatgctaaaaaaaccttaccgctccaccgcctgtgaaaatatanagtgcaaacaatatatactgtaaaaatgta

SEQ ID NO: 53481 - DNA, 101 bp, rice(Oryza sativa)
  misc_feature (71): n=a or g
ctgttgagattatagtcagggacaatatgagattccatcatttcaagaatggagaatgctcctgtggtggnttctggtgaaagcagatctctatatcaaaa

SEQ ID NO: 53482 - DNA, 101 bp, rice(Oryza sativa)
  misc_feature (71): n=a or g
aagccatcatttattccgataagatctaaagagtataccatcaataaccctgtgatcacagctcattgttnccgacatgaaggaaccaaactcgtattgac

SEQ ID NO: 53483 - DNA, 101 bp, rice(Oryza sativa)
  misc_feature (71): n=a or g
ccctccatcgtaatataagtgcaacctagtatagatgtgatatatcttaaactataaatctagacagtatntttatttagatttgtagttttaggatactg

SEQ ID NO: 53484 - DNA, 101 bp, rice(Oryza sativa)
  misc_feature (71): n=t or c
atggtgaccgctactagtcgggtccacgtgccaagttctccagatgacaaaaatgtttctggtttttgttnctgacgcgcgtgcacagatcgacgtcgaca

SEQ ID NO: 53485 - DNA, 101 bp, rice(Oryza sativa)
  misc_feature (71): n=t or c
ctctccctcctactcttaaagttatttttggacgaagccggtatatagttatatgaagtagcatattcgancttgacaagcaaaaactcagtcactcttaa

SEQ ID NO: 53486 - DNA, 101 bp, rice(Oryza sativa)
  misc_feature (71): n=t or c
caccgccgtcgtccgagctcacggccgccgctgttacctgtctgacttgtctccggccacacaataaaacngagccggtgacctcaacgcgcgcggccgcg

SEQ ID NO: 53487 - DNA, 101 bp, rice(Oryza sativa)
  misc_feature (71): n=t or c
aatcaatatccgtttatttttagaaaataagctagagtgtttgcttaattaatacatactccctccgtccnaaaatataaacatttttagctatgaatctg

SEQ ID NO: 53488 - DNA, 101 bp, rice(Oryza sativa)
  misc_feature (71): n=a or c
ttattcctaggtgccaaatttgggtgtaaacacctttctcccccaaggtcgttctcctggatttggaaatnagaatgtgttaacaagataagggtcttcat

SEQ ID NO: 53489 - DNA, 101 bp, rice(Oryza sativa)
  misc_feature (71): n=t or c
tgggaaacctttcccaatttgacccagaaagtccggttttcgccggtttcgtaaaccccggctcagctagnatatatatatttcaatgaagtgaatgaaca

SEQ ID NO: 53490 - DNA, 101 bp, rice(Oryza sativa)
  misc_feature (71): n=a or g
gcgtagtttgcacttgcagatgagaggtctttgggcacaaccaaaatagctgatgaagatgcagtagaganaacagggaagatgccagccgcccttgggca

SEQ ID NO: 53491 - DNA, 101 bp, rice(Oryza sativa)
  misc_feature (71): n=a or g
ctgcagcttccgccgtgtttgtaataaattgtaatgtacccgacgcagcccagtcggcgcgcgctcaggtncgcacctgcgccagcacgggaggtggcgca

SEQ ID NO: 53492 - DNA, 101 bp, rice(Oryza sativa)
  misc_feature (71): n=t or c
catccccaatggatcttccccgagatgacaccaacttagggataaatatttgagatgtgtactgtggctanggaatatcgggtagtccaatgtactcttgg

SEQ ID NO: 53493 - DNA, 101 bp, rice(Oryza sativa)
  misc_feature (71): n=a or g
aacttgaagtgtcacgtcaacaccactcgtagatgccacgcagccgaaaccaccatccaaactactttagnaccttctttgcactgattttggaagtcgag

SEQ ID NO: 53494 - DNA, 101 bp, rice(Oryza sativa)
  misc_feature (71): n=t or c
aaaaaatcggtcgaacattctctatctgttctcagatagaaaatagataatgtgccctagattgttaggantcgtccgataaatatgactgaaagaaaaag

SEQ ID NO: 53495 - DNA, 101 bp, rice(Oryza sativa)
  misc_feature (71): n=a or g
gtcggtcatatcgcacagggagacggagacccggcggatgttcgtggagtggaaggccaagtacgacaagncctacgcctccatcgccgaggaggagtgcc

SEQ ID NO: 53496 - DNA, 101 bp, rice(Oryza sativa)
  misc_feature (71): n=t or c
ggctatccagcactatttgtcttagtgacattctgtaataggatgtagtaaattttgtaatcggctaaganattctgtaatagtcttctgtgccgattaat

SEQ ID NO: 53497 - DNA, 101 bp, rice(Oryza sativa)
  misc_feature (71): n=t or c
atatcggcatatcactgtacgtgtcaatgcgtcaatgctgtctgtctcggacatcaatatcggtatatcantgtacgtgttaatgcgtcaatattgtctct

SEQ ID NO: 53498 - DNA, 101 bp, rice(Oryza sativa)
  misc_feature (71): n=a or g
ctaaggaaactataattaggtaggttagtaggttagagttgacattccctatttttggccccatttcactngaattaaccttgctagttgttgatatataa

SEQ ID NO: 53499 - DNA, 101 bp, rice(Oryza sativa)
  misc_feature (71): n=a or g
ccgccactaagtcaaggcaaaatcataggtagggtcaaaggcaagggcaaaaaggagacacagatatgtgntggatcagtgttcctccatgtcagatatga

SEQ ID NO: 53500 - DNA, 101 bp, rice(Oryza sativa)
  misc_feature (71): n=t or c
gctacggccaccaaagcttgtgtaccaggaagattacagatctacgctacgtgcacacagaaagtacaccnaggttttgcgtttttgcttggtttacccta

SEQ ID NO: 53501 - DNA, 101 bp, rice(Oryza sativa)
  misc_feature (71): n=t or c
cgcagtaatgtggtggggtattcatctagtatactttagtggatcctaaagtaaggcttaaccatcagatnagaatttgaagaaaatcccattataacaaa

SEQ ID NO: 53502 - DNA, 101 bp, rice(Oryza sativa)
  misc_feature (71): n=t or c
gtcttggccttgctattgtcggcgaccctctggtaggtgaggtcgaggagcccatcgattttgaggtagcnggaggccaggaggaccaagaagaggaagga

SEQ ID NO: 53503 - DNA, 101 bp, rice(Oryza sativa)
  misc_feature (71): n=t or g
tctaatcccaagttgttattcttttcttctgcacccgctgtactagcctaattattttttgacgcatcaanggcataggttcattaggaattcttctcttc

SEQ ID NO: 53504 - DNA, 101 bp, rice(Oryza sativa)
  misc_feature (71): n=a or c
gcaaaggcgctgatgatgttattggaaaagggaaacaagtagatgaagggattgggtttggagacaagganaaacatgaagaaaagcaagcacccaatgct

SEQ ID NO: 53505 - DNA, 101 bp, rice(Oryza sativa)
  misc_feature (71): n=a or c
cttgctatggcgaagtcatccgccttcgccataccttcttcgccatatagacttcgcccaaaatgccttcnaccttgtgggataccagtgcgattcttcgc

SEQ ID NO: 53506 - DNA, 101 bp, rice(Oryza sativa)
  misc_feature (71): n=t or c
aaaattattgtttaaaaaaatgttcctcttgttgaccactcactagagccattttattctaggaaagatcngataagtggatgcttgtcgtcaattatgtt

SEQ ID NO: 53507 - DNA, 101 bp, rice(Oryza sativa)
  misc_feature (71): n=a or g
cattccccctctcctccacctcgtcgttgttggagaactgggcagtgagttaggatggtggtgacggggcnaaatcccggcggcacttcttctttgtcatg

SEQ ID NO: 53508 - DNA, 101 bp, rice(Oryza sativa)
  misc_feature (71): n=t or c
ccatctgcccgaacagcagatccaaaagaaggctggaacccagcgccattaaatccacctccactcggacnagcattgagaccaaagccacccctccaccc

SEQ ID NO: 53509 - DNA, 101 bp, rice(Oryza sativa)
  misc_feature (71): n=t or c
gaacaatcgaggaaagagtactgaagaacctgcatgctgtacgtaagatacattaggtgcttgtttctaantttttcttcaaacttttaactttttcatca

SEQ ID NO: 53510 - DNA, 101 bp, rice(Oryza sativa)
  misc_feature (71): n=a or g
gcagggccaggcatccagctcgacgttgccgtcctcgccaccaagcactgccccaagcccaaacgcctcanctgcagcatgttctcttctttttttctgga

SEQ ID NO: 53511 - DNA, 101 bp, rice(Oryza sativa)
  misc_feature (71): n=t or c
tgccagcagcagaatccggttgtctgtcatggctagcagctgtagatcagtaggcagtagatgataccagnagcaatctttggaagagttaacaggattaa

SEQ ID NO: 53512 - DNA, 101 bp, rice(Oryza sativa)
  misc_feature (71): n=t or c
agacccggtcacatatttcactattgtggtgtgcgtctcttgatggagggacatttaaactatataccacnttatataccacttttaagatatggtaattt

SEQ ID NO: 53513 - DNA, 101 bp, rice(Oryza sativa)
  misc_feature (71): n=a or g
aaggcctccgtcggaatctactggtgggctgttctggtggtcaattggactggagattgggttactattcnagccctcctttcactcaaggttcttgggtg

SEQ ID NO: 53514 - DNA, 101 bp, rice(Oryza sativa)
  misc_feature (71): n=a or g
tcgagaatcgcctcgcctctctggtgacatgaggtgtgtgcgtcaccatcaatgctttcttcccactctcnatgagatccttgtcaaatccggcacatcct

SEQ ID NO: 53515 - DNA, 101 bp, rice(Oryza sativa)
  misc_feature (71): n=a or g
aaaaaaaaactcttttagtatagtccattttctagccaaaatgtcctcttgtactgttggtcgcaggctgnattgttggaaagaagtgatttctttcgaag

SEQ ID NO: 53516 - DNA, 101 bp, rice(Oryza sativa)
  misc_feature (71): n=a or c
cttttgcaacggggttaggagaactatgggtgaatggttttattggtttcagttttatctctcagtttctnaaaaaaaaaaaatctctccgttttattaat

SEQ ID NO: 53517 - DNA, 101 bp, rice(Oryza sativa)
  misc_feature (71): n=a or g
cacgcctctgctttgaagatcataagcaaaagcggtataacgttctgtcctattagagatcttcacgtacnggcagtaacaggatatcgaagatcaccttg

SEQ ID NO: 53518 - DNA, 101 bp, rice(Oryza sativa)
  misc_feature (71): n=a or c
ttttacatattgttaactaactaattttaatcttgttacccacatacatattttttcctcccagggccttncggctagctccacaagatggtgggctagac

SEQ ID NO: 53519 - DNA, 101 bp, rice(Oryza sativa)
  misc_feature (71): n=a or g
aagcacccattcaatatggccaagacaatagtataacatatatatatgcatgtctaaaatattctcggcantttttatgtggttctatgtattcataaaat

SEQ ID NO: 53520 - DNA, 101 bp, rice(Oryza sativa)
  misc_feature (71): n=t or c
gaaaatattactacacaatgaagggtagttaaactactgtgtgtaagatttgtgcctcgtgcttgaaaatntcttcgcctttgaaatcctcatattggatt

SEQ ID NO: 53521 - DNA, 101 bp, rice(Oryza sativa)
  misc_feature (71): n=a or g
ataaaaattattatgtcattattgttcgatcgctgttaatctgttcagttgaatgattggcatcagcttcngaagtttggctgtgaatgcttgtcttattt

SEQ ID NO: 53522 - DNA, 101 bp, rice(Oryza sativa)
  misc_feature (71): n=t or g
acgacaagggcatgaaagactggggtggcaacgcaggagaaatgtcggctacgatggcgggatgtacggangcaacgatagtggggattggccggggacga

SEQ ID NO: 53523 - DNA, 101 bp, rice(Oryza sativa)
  misc_feature (71): n=t or c
tcttgactagcactagtacctgttaaaatagtcgaaatagttcttttaataccatcaaaccatgacccaanacatgtgtgatattctataggcgaagtgat

SEQ ID NO: 53524 - DNA, 101 bp, rice(Oryza sativa)
  misc_feature (71): n=a or g
cataagtgcaacaggtaaagaagtagaagtaacagatcaactaagcaactggtgtcgtcgaacctaagtcntcgctagatctaggccacggcatcaaccat

SEQ ID NO: 53525 - DNA, 101 bp, rice(Oryza sativa)
  misc_feature (71): n=a or g
cctcgagcaactccaagagctatctgatatctagtactccaattcagggttacactgttattgcttctgantaaatgagtatcaagggagccattcgacat

SEQ ID NO: 53526 - DNA, 101 bp, rice(Oryza sativa)
  misc_feature (71): n=t or c
tcggtgaaagaacgtgacgaccatcactctgcatctggagtgtactcatcaccagctggtaaacaaatacnctatgatcaccaaaaacgcggttgatccag

SEQ ID NO: 53527 - DNA, 101 bp, rice(Oryza sativa)
  misc_feature (71): n=t or c
aatatcagttcttctattggagaaaaaaaaatactagtagaatattgttttttttaacagtggcagggttnagttcccttcaaacttcaaaaaattccgtc

SEQ ID NO: 53528 - DNA, 101 bp, rice(Oryza sativa)
  misc_feature (71): n=a or g
atactgtctagcctttttcgaggagcgggtttccatcggtttataatttattgggccaattgattgatccnaacgacaacgatgacttgatctagaatgaa

SEQ ID NO: 53529 - DNA, 101 bp, rice(Oryza sativa)
  misc_feature (71): n=a or c
agaaatatagtatttttgggctctagtctttttaggtgattgtggcgggctatcctgcgcttgctagttgntagttgatgaacgtgtgagtgacaactcta

SEQ ID NO: 53530 - DNA, 101 bp, rice(Oryza sativa)
  misc_feature (71): n=a or g
aaccaccatacttcttttgatactgctgtagcagcaggatgatgacaataatggatgccataaaggatgtngagttgcagtagaagaacgcgttgtaccga

SEQ ID NO: 53531 - DNA, 101 bp, rice(Oryza sativa)
  misc_feature (71): n=t or c
gcgcgggggggggggggggtcgagtactgcaagcgagctgcgagcagaggagctctgatttagtgatcttntttttcttttttccgtttctgatttagtga

SEQ ID NO: 53532 - DNA, 101 bp, rice(Oryza sativa)
  misc_feature (71): n=t or g
caaatgtaaacaaacaatattctggcgctatctttaccattgatgcttgtctcaaacaacagacactgtgngcccgtggctccgtacctgtacattcatcg

SEQ ID NO: 53533 - DNA, 101 bp, rice(Oryza sativa)
  misc_feature (71): n=t or c
cttttcttttagaaacacagtacaaagttagaaacgtaggtgcttagaacacacgcaacacacgcacaccnacccttaaaaacgcacgtacaccctatccc

SEQ ID NO: 53534 - DNA, 101 bp, rice(Oryza sativa)
  misc_feature (71): n=a or g
caagaaaagcatccgagttcacaaattcttatgcagggggctcatatttgagagcaggtttaactttgaanttcatttattcttcttggtacttagtctgc

SEQ ID NO: 53535 - DNA, 101 bp, rice(Oryza sativa)
  misc_feature (71): n=a or g
acaggccccctgtccagatggtatctgtccagattcgtactaacaatttagttctgtagttgcttacccantcatggcatgagagcatgaagtggtcagcc

SEQ ID NO: 53536 - DNA, 101 bp, rice(Oryza sativa)
  misc_feature (71): n=a or c
tttggtgtatagcaagactttaactgaacatgtcgagcatctcagacaagtgttacaaatcttgactgatnatcagcttaaggtcaagaggtctaaatgtt

SEQ ID NO: 53537 - DNA, 101 bp, rice(Oryza sativa)
  misc_feature (71): n=a or g
gcatcgaacactgcactattatactccgagagtgggggtaggagagagagaagtagtagtagtagtatccnagaaagctgcgagcttttcttccccgattc

SEQ ID NO: 53538 - DNA, 101 bp, rice(Oryza sativa)
  misc_feature (71): n=t or c
atatctaccatcagagaaatcatccagataatatggagctgcagaagatgctcttatggcttcccatatgngatgcttgcagctacccatgaaagcaccac

SEQ ID NO: 53539 - DNA, 101 bp, rice(Oryza sativa)
  misc_feature (71): n=a or g
aaaccagtgtactggagcttttgtattagtgttaatgatcaattagtatatacatatcacgcggcggagcntgaggcgtgcataggtttcacaaatatata

SEQ ID NO: 53540 - DNA, 101 bp, rice(Oryza sativa)
  misc_feature (71): n=a or g
ttttctctaaattaaactctcccaaaatcgatataaggatatctcaactccctctctatttatacccaagncaagcagcctaaagtcacgaatctaatttg

SEQ ID NO: 53541 - DNA, 101 bp, rice(Oryza sativa)
  misc_feature (71): n=t or c
agatggcaggaagtctgccgttcacttcagatgaaaagatatggaaccacgaccatctggcccaataggcnacatgagaacaaaatcaccatataaatcac

SEQ ID NO: 53542 - DNA, 101 bp, rice(Oryza sativa)
  misc_feature (71): n=t or g
aacaagatttgtgcagaatctgggtaccgggtacacacggtttccatatatattcgaccagagagagtagnactcagtcgcaacgttgtcttgtgttttat

SEQ ID NO: 53543 - DNA, 101 bp, rice(Oryza sativa)
  misc_feature (71): n=a or g
gggttagggttttgcgcggcggtgagattacgaagatttttgctggtgttctttgggggtttatgggtgcntgtgtttgcttttagattcctgatgctgtt

SEQ ID NO: 53544 - DNA, 101 bp, rice(Oryza sativa)
  misc_feature (71): n=t or c
ccattggtgtggagtcatggtgtttccaagtctgcatgaggaattggttgttgacgagctagggtgttagntttaggttgttttggtttggctgggtcttt

SEQ ID NO: 53545 - DNA, 101 bp, rice(Oryza sativa)
  misc_feature (71): n=t or c
aggtctcgcgtggcgtcttctccttgcaccttgattcttatgtcggtctcgatcaagcaggcctccgccantgacatgcccctcgttgggctcatcagggg

SEQ ID NO: 53546 - DNA, 101 bp, rice(Oryza sativa)
  misc_feature (71): n=a or g
cggcggggcaggcataacggcataagcagcgtacgtagctgggtaccgtacaatttcgttgagaatggcangaaatgtaaatatgataaaagtggtactag

SEQ ID NO: 53547 - DNA, 101 bp, rice(Oryza sativa)
  misc_feature (71): n=a or c
agaaccggaggcatctctgtgcagatgtgcttcagagctcatgctggagatgttcatcgtgtcgtaccttntgtaccgatcgctctcgtccatgacacgag

SEQ ID NO: 53548 - DNA, 101 bp, rice(Oryza sativa)
  misc_feature (71): n=t or c
actcaaataaataatcaaacaacaaatatggagtagtagtttgcatggactataaagctgtgttcttcccnctcttttcccaaatcacctctctctttttc

SEQ ID NO: 53549 - DNA, 101 bp, rice(Oryza sativa)
  misc_feature (71): n=t or c
ctttgaagagtggttttactgacgtggcgctaatgtggtagagctgacctgctcttcatcccatgtgacgnctaagtggcattaaaattaaaaaaatatat

SEQ ID NO: 53550 - DNA, 101 bp, rice(Oryza sativa)
  misc_feature (71): n=t or c
cagaggagtggaccaagaaatgggccaaggtttgggccatcccatcaaagctttagcccaatccattgtantgtttgtcagggttatagataagacatacc

SEQ ID NO: 53551 - DNA, 101 bp, rice(Oryza sativa)
  misc_feature (71): n=a or g
caacatagctcattaacattgatccaggtccaatgagtgtcacccacccttgcaaagaaaaggagattacntagcaagtgcaggatcattacagtgcagtt

SEQ ID NO: 53552 - DNA, 101 bp, rice(Oryza sativa)
  misc_feature (71): n=a or g
tctcctacaaaatcagctcttgaagatgctgcattttttggtccatctcactctcaatccagtgagcttcnaagtcccagtgcagatcaaccagccagagt

SEQ ID NO: 53553 - DNA, 101 bp, rice(Oryza sativa)
  misc_feature (71): n=t or c
tgaataaacaaactactccacctgcaaatgcacaaagagaaggttgtgagattgtcctcagtttaatttanaccttctttattcctagtttatagataagc

SEQ ID NO: 53554 - DNA, 101 bp, rice(Oryza sativa)
  misc_feature (71): n=t or c
atggatttttcgtttacctatctcaccgttgtgatgtacccggtacaaagatccataatagagagggaatnatgggtaaacctcgatgacggaccggatgc

SEQ ID NO: 53555 - DNA, 101 bp, rice(Oryza sativa)
  misc_feature (71): n=t or c
ctttaccttttttacctcagtgttcgttcgctcgtttcaaggtcccatgtacagaagagtagaagaccacncgggtgaaaaaaaagaacgcacagtaattt

SEQ ID NO: 53556 - DNA, 101 bp, rice(Oryza sativa)
  misc_feature (71): n=a or g
aaagggaaaaggatttatgaattccttcggaaaagaaaaggaagagggacgtaattcagacttttaggctnagcgtgagacgtggcccaaagaaatgcgcg

SEQ ID NO: 53557 - DNA, 101 bp, rice(Oryza sativa)
  misc_feature (71): n=a or g
aattgtgggagatcaagaaatattcaattgaatttgatagggaggatcggttctagcattatactgacacnagactgacacgagactgttttccggaggtt

SEQ ID NO: 53558 - DNA, 101 bp, rice(Oryza sativa)
  misc_feature (71): n=t or c
gcaccataccccacggcctgaggctgttgagcactgccccaatttgctagaacattattcatcaggtttcncaagctgattttgcacggaccaattttctt

SEQ ID NO: 53559 - DNA, 101 bp, rice(Oryza sativa)
  misc_feature (71): n=a or c
gacagtgtactggttgctagcccgaattaaagaacttcttgtttatgtcaacttatctctctctctctctntatatatatatatagacctaattggcaatt

SEQ ID NO: 53560 - DNA, 101 bp, rice(Oryza sativa)
  misc_feature (71): n=t or c
tagtatggactttgttcaaggattacctaccacacctgccggaaatgacagtatttgggtaatagtagatnggctaacaaaatctacccatttcttaccgg

SEQ ID NO: 53561 - DNA, 101 bp, rice(Oryza sativa)
  misc_feature (71): n=a or g
aggagatgtgacaaaatagtaagtggtagcgacttacgtgacttttgtatactataacactaaaaacaccnggacgataaggttcggtctaaagttctaag

SEQ ID NO: 53562 - DNA, 101 bp, rice(Oryza sativa)
  misc_feature (71): n=t or c
cactgctattgcatcagcagtactgcagaggatctgcatcccttcttaagcatatcatcaatcttgagtanatcgactcccacatgttgatgaacataaat

SEQ ID NO: 53563 - DNA, 101 bp, rice(Oryza sativa)
  misc_feature (71): n=a or g
catatcaaatgataatgtcaactgggaagaattgataaacctgctaccgagtggtagaagtggatgcatgnttttaatcactacacgtcttacaaaaattg

SEQ ID NO: 53564 - DNA, 101 bp, rice(Oryza sativa)
  misc_feature (71): n=a or g
tttcttgaaaacgccaaacagctgcccatttcacactgttttagtggttcaccgagtaaaaaagaaaatgngattgtgggattgtgaatttgtgatacagc

SEQ ID NO: 53565 - DNA, 101 bp, rice(Oryza sativa)
  misc_feature (71): n=t or c
tcttgcaagaatcacagcttttaatttacggaaatggtaaggacaagcctcctactgggctcatgtttganaaacagcagatcaaggggctatatttcaac

SEQ ID NO: 53566 - DNA, 101 bp, rice(Oryza sativa)
  misc_feature (71): n=t or c
gtaccaccttgcctattctaggagagggagatctccctataagggagggtgttctattaaccacttaaaanatgtgtggtggaaaaaataagaggaacaca

SEQ ID NO: 53567 - DNA, 101 bp, rice(Oryza sativa)
  misc_feature (71): n=t or c
ctatcattgtatcgactctctgataggcacagccctacagctaaagccacaacttaaagtttacgcatggnatgtgttatggttacggaatttccggttca

SEQ ID NO: 53568 - DNA, 101 bp, rice(Oryza sativa)
  misc_feature (71): n=t or c
ctgcaaggacgaggagaccctcggccaccgcccagctcgcgtcccaaccactggaatccatttcccctcgngcaccggtgagctaccccttttccaatccc

SEQ ID NO: 53569 - DNA, 101 bp, rice(Oryza sativa)
  misc_feature (71): n=a or g
agtgccaagtgatatatcttagtactatcatctgaacatgctcttatatctagatattcgtaatactacantacaatatgtcactgtccattttaagttta

SEQ ID NO: 53570 - DNA, 101 bp, rice(Oryza sativa)
  misc_feature (71): n=t or c
ataccattctcgggtatagcccgtcgatagtgttgtgcagattcaactatagctatagtgatgaggatatnactagcttggatatgaccatgattacctta

SEQ ID NO: 53571 - DNA, 101 bp, rice(Oryza sativa)
  misc_feature (71): n=a or g
tgcatgggtaaccttgcattaggaagtgggtatgaccatgtgagatagaagcccgagttttaacactaggnaaacctagtcaagactacacctatttagaa

SEQ ID NO: 53572 - DNA, 101 bp, rice(Oryza sativa)
  misc_feature (71): n=a or g
ggtccatgagtggcatatcagtgaatagcatgtttgtggaagacgagtagcatgatggagtaagattgccnttacgctttctcatcttccatctcaagcat

SEQ ID NO: 53573 - DNA, 101 bp, rice(Oryza sativa)
  misc_feature (71): n=t or c
acggcccatgggcccacatgatcatcgttttgggaaaaaaaagttcacattgggtctctcatcttgtcgtngagtttaaaaacatccctgaaccacaaaac

SEQ ID NO: 53574 - DNA, 101 bp, rice(Oryza sativa)
  misc_feature (71): n=a or g
ctactcattctattcttttcttacagtggtgtgatgtgtctatgtgttatgcgtgatgcaccaaggtagtnatgtcttcacccgaaaagcaaagaaaaaaa

SEQ ID NO: 53575 - DNA, 101 bp, rice(Oryza sativa)
  misc_feature (71): n=a or g
aacattgaaacttcgcagtaacccagatatagtctcatgcatctatgcacggcagtaataagaacaaactntattgactttactcacgtcgacgtcatagt

SEQ ID NO: 53576 - DNA, 101 bp, rice(Oryza sativa)
  misc_feature (71): n=a or c
tggtggccttttttaggtccttccagaagccccacatcagttgaaacagttggtgatcacagcaaagttcnctgtcatgtttgatttcaatcaacttcaat

SEQ ID NO: 53577 - DNA, 101 bp, rice(Oryza sativa)
  misc_feature (71): n=t or c
ctctctatctggccactttcctgtccttcatctatgctcttggtcatttcctcaccgagtacctgatatancatactatggctgtggcaaatctgagcact

SEQ ID NO: 53578 - DNA, 101 bp, rice(Oryza sativa)
  misc_feature (71): n=a or c
tcgtgagctattttctccttgtcgtgatctgtacatctgtcgtgagctattttcttattggaaagttttgntacaggacactgcttatgtgcggttttagc

SEQ ID NO: 53579 - DNA, 101 bp, rice(Oryza sativa)
  misc_feature (71): n=a or g
gcaaattaagggcccaagtgatcgatggaggttaattagctagctcttgactttgcaggagatatatgggnaatgaccggcttaacgtttgaggagatttg

SEQ ID NO: 53580 - DNA, 101 bp, rice(Oryza sativa)
  misc_feature (71): n=t or g
ttctgatacaggctcttggggcatgggttgatgagttcatgaacacatatgacatcgaccattggaagaancagtgcgaaaggcaggcacatggcatcgag

SEQ ID NO: 53581 - DNA, 101 bp, rice(Oryza sativa)
  misc_feature (71): n=t or g
tctttactctttaattgactactactctctccttattatgctgttccttgttattggggagggctgagtcnctctcccgttgatatatattttgtttatca

SEQ ID NO: 53582 - DNA, 101 bp, rice(Oryza sativa)
  misc_feature (71): n=t or c
gtagatgcctctactggcctcgcatcatttctttttgtgttatccccttcctttcaaattagacgtccccnttttaaaaaaatttaaactcggtagctttt

SEQ ID NO: 53583 - DNA, 101 bp, rice(Oryza sativa)
  misc_feature (71): n=a or g
gtctgtcattcaatcttaggaaacaagacgtaaaacccgcacgacaacgacaaatatgtaaggacaagaantcgacattgctttatgtcgcatgatacata

SEQ ID NO: 53584 - DNA, 101 bp, rice(Oryza sativa)
  misc_feature (71): n=a or g
ttcgccgacgcgcccaacggcttcctcgccatggacgtcggtggcagcctcatcaagtcggcgactactcngcgcagtgctcggccgatgggttccagctc

SEQ ID NO: 53585 - DNA, 101 bp, rice(Oryza sativa)
  misc_feature (71): n=t or c
ctgaacttgttacacggcaaacaagcctgcggtgtacggataaaagtcgaaccaagcgtagcggaagaacngaggttgtggcggcgcggcatcttcccaga

SEQ ID NO: 53586 - DNA, 101 bp, rice(Oryza sativa)
  misc_feature (71): n=t or c
gtagaaaggttttttacactaagttaaaagtccatgcattaccacggatgtacaagagatgaaagaaaaanaaaaagtataagtttatagcatacttagtc

SEQ ID NO: 53587 - DNA, 101 bp, rice(Oryza sativa)
  misc_feature (71): n=a or c
ttggctttaaagcaggattaggacgattaaagatggacaaaaagagatcagcatagctccatggactgcantcactgaagaatgagaaggacacaacattg

SEQ ID NO: 53588 - DNA, 101 bp, rice(Oryza sativa)
  misc_feature (71): n=t or g
agctcccactccagccccagctccagcaccagcatcatcttcagctcccgcgcctgagttcgtcttcaccnatgctccagcttcagcctacaggggcccag

SEQ ID NO: 53589 - DNA, 101 bp, rice(Oryza sativa)
  misc_feature (71): n=a or g
gcggcttgatctcgttgtgccctgctcatggctacttgctcagatctgcgtggctcttgaagaatgttgtngcaggggtcaccaccattcctccatattcg

SEQ ID NO: 53590 - DNA, 101 bp, rice(Oryza sativa)
  misc_feature (71): n=t or c
acttcgaaacaaagtattaaaatttaagttttggcagtggccgatttgttgtagagcaaactgtaagtgtnccgttttgttttagagcgggcaaaaatatt

SEQ ID NO: 53591 - DNA, 101 bp, rice(Oryza sativa)
  misc_feature (71): n=t or g
ccagttttggaacttctttacttagttaagcactaatggggttagtgtgccacgacaattaatatctccanatgtaaggatgatattaactgaatcttgac

SEQ ID NO: 53592 - DNA, 101 bp, rice(Oryza sativa)
  misc_feature (71): n=t or c
aacaaataaaaagatattagtcactacaaacactcttcattacctagactcaaaactatcagtttccctgnatagttcagttacactgcttggccaccgcc

SEQ ID NO: 53593 - DNA, 101 bp, rice(Oryza sativa)
  misc_feature (71): n=a or g
gttgcaggtatggttggaaaagctcacaggtgttcttatatcaccggctatccccttgaaccgtaaatatntaaattttgcaatgttaatgtagttgatat

SEQ ID NO: 53594 - DNA, 101 bp, rice(Oryza sativa)
  misc_feature (71): n=a or c
caagaccctacttcagcagcaaattgcgaagctccagaagagaagaagctggacaatctgaaggctgaganctacaaacgtgagatcaccaatataatttc

SEQ ID NO: 53595 - DNA, 101 bp, rice(Oryza sativa)
  misc_feature (71): n=t or c
ttaaaattatccttcctagcttgcgtaatttgtacgtctcattgttgatattcattggtcactagcgcagnttcagccacataaccctaataacttttccc

SEQ ID NO: 53596 - DNA, 101 bp, rice(Oryza sativa)
  misc_feature (71): n=a or g
agtcatgtgtgttattagttgacttaacgcacacattgagttatatgactatgtatcacagtttctggtcnaagtaaagcttcacaaattctgttttattt

SEQ ID NO: 53597 - DNA, 101 bp, rice(Oryza sativa)
  misc_feature (71): n=a or g
tgctttccacttgccgctagttttcacttgtttttttccaatttctcgtgccttagtgggcaaccgacatngaaaaataatagatttacctcgtgtcatct

SEQ ID NO: 53598 - DNA, 101 bp, rice(Oryza sativa)
  misc_feature (71): n=t or c
agataggagtcgagtactagatggatgagcacgcagcagtcgcacgcgtgcgttacgtttacgtttacgtngcggcttggcccagggccgtcttatccggc

SEQ ID NO: 53599 - DNA, 101 bp, rice(Oryza sativa)
  misc_feature (71): n=t or c
atcgttggattgggtaatcctaccacagacataggtcatgctgatgatgagtttccccaagattatgatantatgtatcaaaattttgaagatgatgatgt

SEQ ID NO: 53600 - DNA, 101 bp, rice(Oryza sativa)
  misc_feature (71): n=t or c
cctgcgccctagccgccgcttcgcccctccaatccaccactgaggcatcatctctattggcaacccgagcnaccgctgccattgccaccatcccggctgcc

SEQ ID NO: 53601 - DNA, 101 bp, rice(Oryza sativa)
  misc_feature (71): n=a or c
cgtgacaggctaatatgcttgtcaacaaaatcctcaacgaaaaaagaacagagatgaaaccctgacccccnaaaaaaaaaacatttcgatactgttcctac

SEQ ID NO: 53602 - DNA, 101 bp, rice(Oryza sativa)
  misc_feature (71): n=a or g
cataataggccaaccgtgcaggcggggataccatggacgacggtgatgaaggcaagccaacggtaaacacntagaagcccatcgacggtggagtaaccaac

SEQ ID NO: 53603 - DNA, 101 bp, rice(Oryza sativa)
  misc_feature (71): n=t or c
tgttatatatattctctctttctgaggtttctcttaatttatctcttgagtgttgtcaactccaattatgngagatctccttctgttgatcagtaataatg

SEQ ID NO: 53604 - DNA, 101 bp, rice(Oryza sativa)
  misc_feature (71): n=a or g
cttgaatccaatttggcctcctgagattgtgcaaacttcaaacaaccaacagatttgcatacgatacctcnaaattcaatctgggtcaactgcaatcgata

SEQ ID NO: 53605 - DNA, 101 bp, rice(Oryza sativa)
  misc_feature (71): n=a or c
tatccggtagcaacatcttagtaagacggatgaagtacatgatactgcacataccaaacatcggcaatagnaatacttatgatacctagaagaaccatgat

SEQ ID NO: 53606 - DNA, 101 bp, rice(Oryza sativa)
  misc_feature (71): n=a or c
gtccgggagagagtacagtccgcatgatccaaaagaacataaatgcacactccgacgaaattcatgatgcntacgatgcctaaatttttgtgcttcatgtg

SEQ ID NO: 53607 - DNA, 101 bp, rice(Oryza sativa)
  misc_feature (71): n=a or c
aatctacattagcctaacccttctgtagggacaggtccatgcacatatatgtcacgtgcttcactcggtgnatagctagaagaatagagacagtagttgtg

SEQ ID NO: 53608 - DNA, 101 bp, rice(Oryza sativa)
  misc_feature (71): n=t or c
gaaaagctatggctttacagcacgaaaggtgagctgaggcctgaggcgatgagtttaatttcctgtttganttgtgaaacgtgtgcaaaagcccacggaat

SEQ ID NO: 53609 - DNA, 101 bp, rice(Oryza sativa)
  misc_feature (71): n=a or c
tgttgggagtccacttccacattgctaagcaacacccaatacgttaagttgttaagctactcccttcgttncatactactccccctgtttcataagtcgtt

SEQ ID NO: 53610 - DNA, 101 bp, rice(Oryza sativa)
  misc_feature (71): n=a or g
tttaacaaaccacgatttcaatcaaaatactcaatatgcatgggcaaacattggggaaattacggttttcngagggacttcaccatgcaaatcaatctcca

SEQ ID NO: 53611 - DNA, 101 bp, rice(Oryza sativa)
  misc_feature (71): n=a or g
ttaacttgttttgataagaatggatgggccttttggttttcttgctccaatgatgcctatgacgagctggnatgataagctactgcgtgttggggcctggg

SEQ ID NO: 53612 - DNA, 101 bp, rice(Oryza sativa)
  misc_feature (71): n=a or c
acaagcgatcagaagcggggaagcagaacagtagcagctcaggcgtgcacgaggaggaggaggaagaacancagatggaaagtgagtagccgcatctgatc

SEQ ID NO: 53613 - DNA, 101 bp, rice(Oryza sativa)
  misc_feature (71): n=t or c
ttagctaggaaaaacccaggtacaaaagttaaactcagaaatagcccatgtattattgaagagaaaattcnctatctagcataaaaaaagttgctcttccc

SEQ ID NO: 53614 - DNA, 101 bp, rice(Oryza sativa)
  misc_feature (71): n=t or g
aaattgctaaactcattgcaaaagagagcactgagaggttgacaccgacggctaccctgtcttaggctctnagcctgctccgctaccgatagatccggtgc

SEQ ID NO: 53615 - DNA, 101 bp, rice(Oryza sativa)
  misc_feature (71): n=a or c
tcagtcttccggcctagctacgtaccggtttcagccctacttgtaaaagttcttgttatgcatcggtttgnacagcaacagcaagactacaaatgcaaata

SEQ ID NO: 53616 - DNA, 101 bp, rice(Oryza sativa)
  misc_feature (71): n=a or g
gtaacaacaatacaacataactctgtatttgcagatttcacaatctggctgagtttgacgatgggaaaaanagttgccggaaacggctggatggtcataac

SEQ ID NO: 53617 - DNA, 101 bp, rice(Oryza sativa)
  misc_feature (71): n=a or g
ctcgatcattgatcccaagattaaactgattgttcatttgcacatcaacatcatttccgctcaagagaganaaaaaaaacactgaggcacttttatgatat

SEQ ID NO: 53618 - DNA, 101 bp, rice(Oryza sativa)
  misc_feature (71): n=t or c
atgtatctatctatgtatttagtgtccagcaaacaatttagtgtccagcaagcaatatgaggaggtaaggngcaggggcatttcggtccgaccgcgtcaaa

SEQ ID NO: 53619 - DNA, 101 bp, rice(Oryza sativa)
  misc_feature (71): n=t or c
gttgcagcgcgtcccgataaccctcgcgcccctcttccggccgaagtactgaggtatcaacgcgattatgnccccgaggcagctccggcagtcgtccggcg

SEQ ID NO: 53620 - DNA, 101 bp, rice(Oryza sativa)
  misc_feature (71): n=t or c
taaatgtttataaaatggtaaatttagctgtaggatctcacgactttatggttttgactctaggacacaangacgagctttggaaaaaacactctcaaaat

SEQ ID NO: 53621 - DNA, 101 bp, rice(Oryza sativa)
  misc_feature (71): n=t or c
tgatgcgggatatgtatggatcatgctgcgtacgactgcagcagtggtattacattattattactaagggnctgtttgtatgtgtaagtttagttgaaatt

SEQ ID NO: 53622 - DNA, 101 bp, rice(Oryza sativa)
  misc_feature (71): n=a or g
ttcttggctctgctcgctttttttcgtggtaaatctgtgtgcaagatctggggtacaaaaggaggggacancagcacaagggaggaggaggagttcttgcg

SEQ ID NO: 53623 - DNA, 101 bp, rice(Oryza sativa)
  misc_feature (71): n=a or g
gaaagtaagtgaataatcatgcctggttaattcttagtttgaattcacacaaccttttatgattaaaattntcttgacacgcatccaggctaaatttgaac

SEQ ID NO: 53624 - DNA, 101 bp, rice(Oryza sativa)
  misc_feature (71): n=t or c
acaatagcttctccagtaaccgggcgtgcagcacctcaaacaccaactagcagactttctttggctaccanagagcaagcaagtcatgttgatccactgtc

SEQ ID NO: 53625 - DNA, 101 bp, rice(Oryza sativa)
  misc_feature (71): n=t or c
atcacacatgcatccatgatgctaacaatggaatcctctatgtccagataagccaatgtctcgaaactaancgctgcttccagtaacagtggaagggcagg

SEQ ID NO: 53626 - DNA, 101 bp, rice(Oryza sativa)
  misc_feature (71): n=a or g
aacaacgcccagttgacctcgtcgcctgacagtgaggtcctctcaaaatattctattaaaactcttttagntactctttccatctcaaaataaatttaatt

SEQ ID NO: 53627 - DNA, 101 bp, rice(Oryza sativa)
  misc_feature (71): n=t or c
aagcttagaaacaagagagcctatttctttggacggagaattcaactgggagaagtcatgatcgatgagcncaaagggaggaaaaataacaaccaatcaat

SEQ ID NO: 53628 - DNA, 101 bp, rice(Oryza sativa)
  misc_feature (71): n=t or c
tatacttatttttgttagttctatgtacatcatatataagttcctgccgtgtaaacttgtgaaatttggtngcagatggatcttacctctacattctgcat

SEQ ID NO: 53629 - DNA, 101 bp, rice(Oryza sativa)
  misc_feature (71): n=t or c
aaggcgaaataactagtcggcaatgacagaagtagccagaggtgaaaacgtagccatccattagcaacganggagacgtcagggccgatgaagtagaggtg

SEQ ID NO: 53630 - DNA, 101 bp, rice(Oryza sativa)
  misc_feature (71): n=a or g
atagacctttttactaggcaaaccacacgaatacacgattgattaatttcactgagaatagcacgggtacntcacatcacacaaattcatacgttgataca

SEQ ID NO: 53631 - DNA, 101 bp, rice(Oryza sativa)
  misc_feature (71): n=t or c
cgcctcccttaaccacgaaacagagtataacgccttgtccattttgaaaagcagtgcaaaccgactacttntgtggttttaaaagcagcttttgttaatgt

SEQ ID NO: 53632 - DNA, 101 bp, rice(Oryza sativa)
  misc_feature (71): n=a or g
cattctaaaaaaaaaggtcaactcaaacaattaatgatctgaaagcttcaactatctagatgatgaaccantttcatccaatgttcacgatttttaaatga

SEQ ID NO: 53633 - DNA, 101 bp, rice(Oryza sativa)
  misc_feature (71): n=a or g
tgattatcactagcgatgatgctgattttattgcttttgttaaggcacgtctcaatgctcaatttcttatntctgatcttggttctcttcgctattttcta

SEQ ID NO: 53634 - DNA, 101 bp, rice(Oryza sativa)
  misc_feature (71): n=t or c
tcaccccagaaattagatcaaaacaagcccactacgcccatcaataaaccctagcagggtaccagtccaanacccgcacgcgtacagcacgccgccagctg

SEQ ID NO: 53635 - DNA, 101 bp, rice(Oryza sativa)
  misc_feature (71): n=a or g
gccgcccaccatccaccgcgacctcaagtgcgacaacatcttcgtcaacggcaaccagagggaggtcaagntcggcgacctcggcctcgctgcgttccgcc

SEQ ID NO: 53636 - DNA, 101 bp, rice(Oryza sativa)
  misc_feature (71): n=t or c
tgcattatagtactaactaattcgatcatccattttttgaaggatgaattacgtcatagcagaacagatgngtgagactgtcggcttcctaaacccttgcc

SEQ ID NO: 53637 - DNA, 101 bp, rice(Oryza sativa)
  misc_feature (71): n=a or g
actatacctgcatggataagaccaagtaataaaacaattcagctaccgtggaagcatttgcagtgcgtccnatgtaattggcataccttgttgattcctga

SEQ ID NO: 53638 - DNA, 101 bp, rice(Oryza sativa)
  misc_feature (71): n=t or c
taaggggccgcacgtgaaaaatatattttgtagacaggcctcttaaggatccgcttagaagtctgacttangtcctttttttccctctcaacacttcaaaa

SEQ ID NO: 53639 - DNA, 101 bp, rice(Oryza sativa)
  misc_feature (71): n=a or g
cagttcatttgttgtcctcctgctcctctcaccgcttgccatctcccacctctcaccgtggagctctcttntcacatcctgatttttgtcttaagatttat

SEQ ID NO: 53640 - DNA, 101 bp, rice(Oryza sativa)
  misc_feature (71): n=a or g
ttcttgagagaccatcaaataaaatgctatatgtgaagccatcgggcaccatcttttgtgatgccatttcntccaacaaggctgacgtctctcccatcctg

SEQ ID NO: 53641 - DNA, 101 bp, rice(Oryza sativa)
  misc_feature (71): n=a or g
ttgtagttgaacttgccgccgcctgacccgcagcacgtctcgaacaccgtgctaaatcctacatgtcaaanaatatatatagctcatcagtttaatcatct

SEQ ID NO: 53642 - DNA, 101 bp, rice(Oryza sativa)
  misc_feature (71): n=t or g
agctctagtggtagacatggtgagagatatgtgacatctcgttttctattcatagtgccaagttgacgcanagagggatgaagacgtgtgacgtggaaaga

SEQ ID NO: 53643 - DNA, 101 bp, rice(Oryza sativa)
  misc_feature (71): n=t or g
ccgtgggcgcaatttactcatttttttttcaaagagtgtgattccgggatatagggccgatgcacttgctngctaatcaaggccatgtacaacgactcgac

SEQ ID NO: 53644 - DNA, 101 bp, rice(Oryza sativa)
  misc_feature (71): n=a or g
gtcgcctccaccgtcgctggtcgcaatcgcgtcgccgccgccatctccaacttccatcgccacactaacgngaagaaaacgggaagaacccgacctaacga

SEQ ID NO: 53645 - DNA, 101 bp, rice(Oryza sativa)
  misc_feature (71): n=a or g
gattcagcaacgtacgtgtaactctgccttggcactttggcagtgaatactgaacaataacggaatttatnactctgtttccttgaaaataaaacagggca

SEQ ID NO: 53646 - DNA, 101 bp, rice(Oryza sativa)
  misc_feature (71): n=a or g
tgacaagttgagggaccttcggtgtactttttcctttgttggtggaagttggaacacaccatgatgttgcntggtgacgggctagagtctaagcatactcc

SEQ ID NO: 53647 - DNA, 101 bp, rice(Oryza sativa)
  misc_feature (71): n=t or g
catcagtaagaagagtccccagtcttgtttgcctccttgatgtggctccatttcttaggtggagggaaaantaatcactctaagaatggttcgacattgta

SEQ ID NO: 53648 - DNA, 101 bp, rice(Oryza sativa)
  misc_feature (71): n=a or g
taacagaatattgcttgcctgcaaggtttatgctagttttccacaaagtgtagtttagggcttgttttctngcttttgccaatccaaaccttacaaatata

SEQ ID NO: 53649 - DNA, 101 bp, rice(Oryza sativa)
  misc_feature (71): n=t or g
caagcaatactcaggaaagctctctttcccttggaaaaaaaaaagaaagaagaccgacacatttaatgctnatgtatatgacggaaaagttgaaagtttga

SEQ ID NO: 53650 - DNA, 101 bp, rice(Oryza sativa)
  misc_feature (71): n=t or c
attcaaacaagctggacttttgatttctggaggaacaacgcctgtttgtaactgacaccgtgtttagttgnaaacttttcttatcaaactttcaacttttt

SEQ ID NO: 53651 - DNA, 101 bp, rice(Oryza sativa)
  misc_feature (71): n=t or c
tcactcagcccacgtatttttctcgtgggctctacggtgaagtccacgtattttaggaaggaatgaactanggaagaattttgtagaaagcttataggaat

SEQ ID NO: 53652 - DNA, 101 bp, rice(Oryza sativa)
  misc_feature (71): n=a or g
ccgccaatattttcaccggtaaaggaagtaccaactgaaaaaacatagtgaaagtttgagatgtaaagtgnatttctttcttcttttttataacaatgatt

SEQ ID NO: 53653 - DNA, 101 bp, rice(Oryza sativa)
  misc_feature (71): n=t or c
tacttgcgtgttgaagaatgtcaaattttgaattgatattttcatagtcaagtgtatgtcgataaagctcnatctcttttggagttggagctcaaccaaac

SEQ ID NO: 53654 - DNA, 101 bp, rice(Oryza sativa)
  misc_feature (71): n=t or g
acaaatctgggttggccacttccatcaaaaaagttttttagaaacacgatgttatgatgccgaatgttttncagcaaagaatatgcatttgcctttttacg

SEQ ID NO: 53655 - DNA, 101 bp, rice(Oryza sativa)
  misc_feature (71): n=t or g
acggggtagtcgacaatgcacatcgcacgcttgtacagtggcatgcctctccatgaatggaatggaatttncaatgagccaaaaaaaaaaatcaaagtcaa

SEQ ID NO: 53656 - DNA, 101 bp, rice(Oryza sativa)
  misc_feature (71): n=a or g
ttaaacacattagttatcagtttggaaagcgtaaccacgtagaacgagaaagtagctcagtagagtagctnaatcgaactcagcgtaagcaattggtttta

SEQ ID NO: 53657 - DNA, 101 bp, rice(Oryza sativa)
  misc_feature (71): n=t or g
tcatcaatcaggatgatagtatgctttctttgcgatccaaagttggttggagaaagcaacgaatatttccntatcttctcgacaaagttttcaaattcttc

SEQ ID NO: 53658 - DNA, 101 bp, rice(Oryza sativa)
  misc_feature (71): n=t or c
gcttcgcaaggccgtgaggatgcccggccaacactccgccctcgtcatccactgttgagactccgttctcnaggcgtgtggtgagctccgcagcccttgtc

SEQ ID NO: 53659 - DNA, 101 bp, rice(Oryza sativa)
  misc_feature (71): n=a or g
agctgacgtaccaaacttgatttcaccccttggcagctaacatggtaaacggataagtaggtgagtttaantgtaaaccatttttgatacctctataaatc

SEQ ID NO: 53660 - DNA, 101 bp, rice(Oryza sativa)
  misc_feature (71): n=a or g
atccaaatcaaaaacgggatgaactaatcaaactgaagagtgggcttgctagttgtacatggtagaatcanacttcatcgatgacaaacggaagtttgcca

SEQ ID NO: 53661 - DNA, 101 bp, rice(Oryza sativa)
  misc_feature (71): n=t or c
gccagttcatatgtacagatcatccgaactacaacaaagatatacgtaactagtacttcctcttcctctgnttcattcattaatatatatatcacaaaaaa

SEQ ID NO: 53662 - DNA, 101 bp, rice(Oryza sativa)
  misc_feature (71): n=a or g
tgtataattaacaatactatatgtatgtatctgctgcattctgaggaagaacaaaaaaaaaatacctcccnacgcatgatgaattcctgtctatctccaag

SEQ ID NO: 53663 - DNA, 101 bp, rice(Oryza sativa)
  misc_feature (71): n=t or c
ttaattttgtttgaaatagggaatgagcttaatttggccatgtacatagcaagtgacaaaagacatgtgtnttccatgtaatcgaggagaaaaaatagtac

SEQ ID NO: 53664 - DNA, 101 bp, rice(Oryza sativa)
  misc_feature (71): n=t or c
ccaagagaaaggcgaccgacagggagaagggtgcatgacaaccaacagagaggagctgggtggcagcagcngtgtcaccaagctcgacccgcagggaggtc

SEQ ID NO: 53665 - DNA, 101 bp, rice(Oryza sativa)
  misc_feature (71): n=t or g
aatgactttttcttaatgctgatctgaccttggttaatggcgatgacttcagggttggagaggatctccancgtctccctggagatactcctcacgtcgca

SEQ ID NO: 53666 - DNA, 101 bp, rice(Oryza sativa)
  misc_feature (71): n=t or c
aagtcacaaattaatatatactgctataattctcgtactctgaaggagaggacgagttagcacaagcaacnttcttaggcaatatttccatacacaaagaa

SEQ ID NO: 53667 - DNA, 101 bp, rice(Oryza sativa)
  misc_feature (71): n=t or c
cggtttattcgacctgcaaccgtttcgttttgttgtaatgctccaacatgatctcagtctcgtacaattcngtgcaactaagtcatgcttattcatgaagt

SEQ ID NO: 53668 - DNA, 101 bp, rice(Oryza sativa)
  misc_feature (71): n=t or c
acgctagactaagatagtgttgtgattgaacatgtcagcaccggtttttctggtgctgaacccatgctagngtggcacaacagacgagctagcgacctgac

SEQ ID NO: 53669 - DNA, 101 bp, rice(Oryza sativa)
  misc_feature (71): n=a or g
accaagatcggcccctcgtcactcatgcaccatgaccacaccctcactttacattctcatcaaagataaanaaaatagtaacaagttcttttaacttgata

SEQ ID NO: 53670 - DNA, 101 bp, rice(Oryza sativa)
  misc_feature (71): n=t or g
gagaaacagatgtattgcacaatccatcgaggtacttatcccacagtgtttcgtcgacaggcaaaaatggnaactcgtgtgatataaatcctaacaatggt

SEQ ID NO: 53671 - DNA, 101 bp, rice(Oryza sativa)
  misc_feature (71): n=t or c
aaggaactggcgaaacagaagtctgcatagcggtataattgaagcactggacaggacgaagattgccggtntgagagcgagttaccatagcatgacgctgt

SEQ ID NO: 53672 - DNA, 101 bp, rice(Oryza sativa)
  misc_feature (71): n=t or c
tggatcccttccatccatctgcaaatcaaactgctgcttcttcctgcctgaatttgtttgactttgtcganggacgatgatggaatgtggcgccggctaaa

SEQ ID NO: 53673 - DNA, 101 bp, rice(Oryza sativa)
  misc_feature (71): n=a or g
gcctcgcgcgtcgcaacttcgccgcgcaagcagtcgaccctgcgatccacaaggctgcatcggccgtcaanaccttcgccgttattttgcttgtcggtgat

SEQ ID NO: 53674 - DNA, 101 bp, rice(Oryza sativa)
  misc_feature (71): n=a or c
atgcaacgagacacggggacggatggagataaacgaaagcaaatctagctccctccctctcactcacgganggagacacagacaagagggctaagccaatc

SEQ ID NO: 53675 - DNA, 101 bp, rice(Oryza sativa)
  misc_feature (71): n=t or c
ggtgatcgagccgttgttgccagaagtgttgccaccaccttggatagtcgtgggcgcaccgccagatgcgncacccataggtgaagaggagcctgtggacg

SEQ ID NO: 53676 - DNA, 101 bp, rice(Oryza sativa)
  misc_feature (71): n=t or c
agttctaactgattgtcaaaaatacagtttcgtgggacaggtgttgggatccacatgttattccagcactncgttgttcattgatgctatttgcagtttgt

SEQ ID NO: 53677 - DNA, 101 bp, rice(Oryza sativa)
  misc_feature (71): n=a or g
tagaatttgtgaaaggtagttctccagtgaatgagttatgactcaggttaagtatttccagggctgacatntcagaaaatgaacttgggatatctccactg

SEQ ID NO: 53678 - DNA, 101 bp, rice(Oryza sativa)
  misc_feature (71): n=t or c
cgcccgatcggttaaacgctggaaggcttttatgtggttatcttggggtagtgtagctggcattaagaagntttttcactatgtcaaacagagaatataag

SEQ ID NO: 53679 - DNA, 101 bp, rice(Oryza sativa)
  misc_feature (71): n=t or c
cttcatgcatggtgacaagtcacgcatcattaaggcaagaaaaaaaatgcaagagccatggtgatcgaatncctcaaaagtactaaaatttcttgacaaaa

SEQ ID NO: 53680 - DNA, 101 bp, rice(Oryza sativa)
  misc_feature (71): n=a or g
ttttgttgcaaacgattggttttagttaacctaattttgactaatctagctcactccatcaacaattagancactatagctagtgtgttaatccatacatc

SEQ ID NO: 53681 - DNA, 101 bp, rice(Oryza sativa)
  misc_feature (71): n=a or g
taattgcaaaaaagctgcaaatggggtagaaatccaactgaaatgagaagcatctgtccacatcaaaatcntaggaaaatttattacaatgatttgaggag

SEQ ID NO: 53682 - DNA, 101 bp, rice(Oryza sativa)
  misc_feature (71): n=a or g
gggtgttggcctcatagaggcggccgtggcggttggcgaacctaggcctctgatccaggatgttgaagggnccgcacgacgactcgccaaatggcagcagc

SEQ ID NO: 53683 - DNA, 101 bp, rice(Oryza sativa)
  misc_feature (71): n=t or c
ggccggctgctccacaccaagtcaccgaccagctcacgtaggtcatcgtttcagatcaaatctccaacttnaaggctgtgtttgatggtgaggggattgag

SEQ ID NO: 53684 - DNA, 101 bp, rice(Oryza sativa)
  misc_feature (71): n=a or c
cgggagtcgttctccttccgtcctcttcctcatcgcgcgcaggaggtcgtccactcgatcactcctttacncaaccgttacaaggtgtactgctttgttct

SEQ ID NO: 53685 - DNA, 101 bp, rice(Oryza sativa)
  misc_feature (71): n=t or c
tacgctgccatcaaacaacccaaacgggcacgagtaaactttatctatgtgtctggtgactgctggtagantggtactcttcaaaggagcgaggcattttt

SEQ ID NO: 53686 - DNA, 101 bp, rice(Oryza sativa)
  misc_feature (71): n=t or c
tactcaatcgctgcattgcgctccaccccaaaatcacactgctcctccgccgacgccctctcctcgttgcngactatcacccttactcatcgcggtctatg

SEQ ID NO: 53687 - DNA, 101 bp, rice(Oryza sativa)
  misc_feature (71): n=a or g
tcatgactgcgattaaaatgggacgggggagtaggtaattgtaattaaaattcaactgagatggagttggnttttcttgcgaaagatgcatagagagttcg

SEQ ID NO: 53688 - DNA, 101 bp, rice(Oryza sativa)
  misc_feature (71): n=a or g
tttgattagcacccatatgtaattgtcacctagttgggcggttttagctggcaattttggtgaagatggangtaagacttaatgcacatctctacttaacc

SEQ ID NO: 53689 - DNA, 101 bp, rice(Oryza sativa)
  misc_feature (71): n=a or g
tatgtcaacaagattagaaagaaaaaatagccaagctaatttggacttctatacatggatcgaaagaccanatgttaaaagagcaatgatattcaaacaaa

SEQ ID NO: 53690 - DNA, 101 bp, rice(Oryza sativa)
  misc_feature (71): n=a or c
tcccatcaacacgttggattatgaagcagattactactatctgtaccaagggcagatattttctttatttntaaaaaaatggacagctgaaggaatttctg

SEQ ID NO: 53691 - DNA, 101 bp, rice(Oryza sativa)
  misc_feature (71): n=t or g
ggtacagtgcagctgttgcaaacccaacacgacgttcatcagcgccgccgagaagaagcccgtcgcccacngcttgccggaactgcttaacgtcaaggcca

SEQ ID NO: 53692 - DNA, 101 bp, rice(Oryza sativa)
  misc_feature (71): n=t or c
ttaaaggaataattctatttggccttcgtttgtattgcttccagttgaatcccctttcccagacacaaaantgggtataacgcctccccatatttgaaaac

SEQ ID NO: 53693 - DNA, 101 bp, rice(Oryza sativa)
  misc_feature (71): n=t or c
taaaccgatggtgcattggtagtatgttgctggttgcctgtcaccaaattcctgtatggtgggaagacgcnacctggtagaaagactggccaagtgttttg

SEQ ID NO: 53694 - DNA, 101 bp, rice(Oryza sativa)
  misc_feature (71): n=a or c
ttccccgattggagcgttaactctggaagctggcatactccctttcctcggcctctgcctctccacggtgntcggagagaggctcgcgtggctcgtattgg

SEQ ID NO: 53695 - DNA, 101 bp, rice(Oryza sativa)
  misc_feature (71): n=t or c
atactaggattctgaacagagttgtaatatgtcacaatcaccaccactacgagaaaagccaattatgtaangaaacggtttcctgaaccctgtggatacga

SEQ ID NO: 53696 - DNA, 101 bp, rice(Oryza sativa)
  misc_feature (71): n=a or g
agctaccagctaagggagggacagaacgctcaggtccgacataatgaactttgtcgccctgagctaatacnaaataatcctgtgacaatgcattcgagccc

SEQ ID NO: 53697 - DNA, 101 bp, rice(Oryza sativa)
  misc_feature (71): n=a or g
ttagaatatcagatttttattgtattatgacaaatatttgatagagatcgactagctaagtataatttggnatttgccggctcagtcttcgaagatgctca

SEQ ID NO: 53698 - DNA, 101 bp, rice(Oryza sativa)
  misc_feature (71): n=a or g
atgtatatttaaaattcaataatatcatcaatgataagctaaagttcaaaaggaggaaaatctcgtccagnctttccgacacatcaaataaggaataagtc

SEQ ID NO: 53699 - DNA, 101 bp, rice(Oryza sativa)
  misc_feature (71): n=t or c
cgtcgagccgtgaagaggacgatgacggggaggatgccaccacctccgccttgccacagccactacagtgncgtgccgcagcctccatcatggcccgtgcg

SEQ ID NO: 53700 - DNA, 101 bp, rice(Oryza sativa)
  misc_feature (71): n=a or g
ccaaatggctaccaagtactactattcaaggctaccaaatacttggtagggcaggaattggcctcaaaccnaaacggccctaaatctacattatattgatc

SEQ ID NO: 53701 - DNA, 101 bp, rice(Oryza sativa)
  misc_feature (71): n=a or g
gtcgaattgcttaacgaccacatgagaggatataagcgtcattaacatctagtacacaagaagattgattnaaaaattataatgaatatgattatatactc

SEQ ID NO: 53702 - DNA, 101 bp, rice(Oryza sativa)
  misc_feature (71): n=t or c
gctcaccagcagcagctgcagctgtgtggctatccatcgatcagattcatggctatctagctacctctctntctctcccatatggcattgccatggcaaat

SEQ ID NO: 53703 - DNA, 101 bp, rice(Oryza sativa)
  misc_feature (71): n=a or c
tacaagtagtattttcaaaattgtatatgtgcaccttgtatgtgatgaatagaatagcactctctccattntaaaatagagtaacccaagatatgattgga

SEQ ID NO: 53704 - DNA, 101 bp, rice(Oryza sativa)
  misc_feature (71): n=t or c
actcataatatgatgaaattccaaaacagtttgctaatactacctgcacaactcgtcaggaagtgtgccantgtttcttaatttgtcgggctaacttcacc

SEQ ID NO: 53705 - DNA, 101 bp, rice(Oryza sativa)
  misc_feature (71): n=t or c
tggaacaaaatatcctaacacctatcaagatttgccggaatgcccctagcatttcccacttactgtatgcngacgatactcttctgtgttaatgcagaagt

SEQ ID NO: 53706 - DNA, 101 bp, rice(Oryza sativa)
  misc_feature (71): n=a or g
gataaacacaatgtctatgctagttcgagtctttgacttagcacgaatgctcatattttagtggtggactncgtattcatcgataatgagatatctcaaca

SEQ ID NO: 53707 - DNA, 101 bp, rice(Oryza sativa)
  misc_feature (71): n=a or c
tcctaaaacgttttgtctgttagatactgagaaattaagtataattacaaggatcagttaccttttttgcngcgccgtgcctttctccacataagaaatcc

SEQ ID NO: 53708 - DNA, 101 bp, rice(Oryza sativa)
  misc_feature (71): n=t or g
ccttctgtccacttatgcgctcctttttcagtgtttgctcttcatgaagttttcagtcgggacgggacgcnaatgatgtctgaaacctttgctcatgcaag

SEQ ID NO: 53709 - DNA, 101 bp, rice(Oryza sativa)
  misc_feature (71): n=a or g
accgtgagattggtgcaccttcccagagccacaggaatgcttccatccagagaatttgtgctcagattcancacccgaagcctgctgagatggccgagctc

SEQ ID NO: 53710 - DNA, 101 bp, rice(Oryza sativa)
  misc_feature (71): n=t or c
tttgtcaactttggaaactggacatgacatcctaaaccaggttttatgatagttttgcttgatattatagngatttttcagtagcatgacctttgattatg

SEQ ID NO: 53711 - DNA, 101 bp, rice(Oryza sativa)
  misc_feature (71): n=t or g
acaagaattggtcgctatgtggacttccaggtaatgcaaatactccctccgtactacttctactagcagcntacttccccagtctatattagtaaagaagg

SEQ ID NO: 53712 - DNA, 101 bp, rice(Oryza sativa)
  misc_feature (71): n=t or c
cttttgaaaaaactcaatattaggtgtacatcaatatggcaatatcttgttagaacatacaagctccatcngttttatattataagactttgggtttgccc

SEQ ID NO: 53713 - DNA, 101 bp, rice(Oryza sativa)
  misc_feature (71): n=a or g
cttgcctcgccgccgccgccctcccccggtatatgtgaatactttttctttcgtatagatatgtacgccantctctacaatcgactggtgagtttaaagag

SEQ ID NO: 53714 - DNA, 101 bp, rice(Oryza sativa)
  misc_feature (71): n=t or g
ctagtggagcgtgcagatcaggcaacagtacatgtgatccatcctcagacgcactccggcctcgatagctngatggagatcgttggcagagacgacgacaa

SEQ ID NO: 53715 - DNA, 101 bp, rice(Oryza sativa)
  misc_feature (71): n=a or g
aaaagaatcactccctgattctgtatacacctacatcccagctcagaagactgtgtacctgccagtgcatntgccatcgggtattaaaaacaccaaagaga

SEQ ID NO: 53716 - DNA, 101 bp, rice(Oryza sativa)
  misc_feature (71): n=t or c
caccaataagttaacactgtcaaagcaaacgttaaaagttggggcaaaactctggttcgttttaaaatagnaggggtaaattcgcaaaccctaaaaagtga

SEQ ID NO: 53717 - DNA, 101 bp, rice(Oryza sativa)
  misc_feature (71): n=a or g
agctatacctcatttataaatgtggataaatgattgaattgtttggtgtaccttttgagggggaagagatncaatttacaccattgatgaatcatccaaag

SEQ ID NO: 53718 - DNA, 101 bp, rice(Oryza sativa)
  misc_feature (71): n=t or c
gacatgccagactcagaagacagctctgcctttgagcaagaggtagtgaagctgatggaaacgagcatcancagcgcgatgcagtatcttcagaacaaggg

SEQ ID NO: 53719 - DNA, 101 bp, rice(Oryza sativa)
  misc_feature (71): n=t or c
ttgttttcgtatatatctcattcctacaaaccgaatgatactatcatactagtaggaattgatgagaacanggagaaattaaattatgtgttcttcaactg

SEQ ID NO: 53720 - DNA, 101 bp, rice(Oryza sativa)
  misc_feature (71): n=a or g
ggttgctgcctctactctcaacatggccaaggctacaggagaaaagaaaaaagttgccgcggtttccatcntctacatgattgctgctgatgcggttgacg

SEQ ID NO: 53721 - DNA, 101 bp, rice(Oryza sativa)
  misc_feature (71): n=a or g
gggtcagctcccgcgagctagattcgctcgtgtagtagttgaacccaaaaacttaccctgttttcaccctnaaattggacttccaataatacccacgctag

SEQ ID NO: 53722 - DNA, 101 bp, rice(Oryza sativa)
  misc_feature (71): n=t or c
ttgccggtttgagcatagtaaaacgtgcgttactttcaccgtgcttttccatatgaaaatgtgtacccatngtaaaaagtacttctaagctagctacagta

SEQ ID NO: 53723 - DNA, 101 bp, rice(Oryza sativa)
  misc_feature (71): n=t or c
ttcagggaatatgacttctgtcatgcaaccctgacaggttattgttactgcaaaaagtactgaactccaanatcttttatttcccttgaaattatttgacc

SEQ ID NO: 53724 - DNA, 101 bp, rice(Oryza sativa)
  misc_feature (71): n=a or g
aaaaaatattcttaattgccaaaaaggtacaaaaattttcagaactcagaaaaacgcagccaaacctcacnaccaaatgtaatcttacatgaatacaaagg

SEQ ID NO: 53725 - DNA, 101 bp, rice(Oryza sativa)
  misc_feature (71): n=t or c
ccacttttttaagggaatatgccagcaaccattgatgtagtttattgtcactggaatctagaaccttatcngaagcctttttttttttccttgttattcat

SEQ ID NO: 53726 - DNA, 101 bp, rice(Oryza sativa)
  misc_feature (71): n=t or c
ggctgaagtcggttggcgaccagcctggtttggtggaaccagtgttgtgccacctggcccccatcttccangtggagggccaggatcacttgctgatggcg

SEQ ID NO: 53727 - DNA, 101 bp, rice(Oryza sativa)
  misc_feature (71): n=t or c
cgtcagcacaatatacgatgtaatccttgccgttgtccttctcctcttcatcatcgtcatcacttggagcngtggcctttccgggtatgagatgaagaagc

SEQ ID NO: 53728 - DNA, 101 bp, rice(Oryza sativa)
  misc_feature (71): n=a or c
ctgcattaaattgtggaaataatactgcaacagattatgttgaggccctgacaacattacatgtcttttcngattgtagccaaaataaaccttatcaagtt

SEQ ID NO: 53729 - DNA, 101 bp, rice(Oryza sativa)
  misc_feature (71): n=a or g
tccaaccttaggaggcgacgatgccaatgacatagaagaaatcctccacgctctgccatctactgagtacnaaccccctatctaggctgcctggttcaacg

SEQ ID NO: 53730 - DNA, 101 bp, rice(Oryza sativa)
  misc_feature (71): n=t or g
cccagcgccggatccactgccgccgaggttccccatgcaggatacgccactccgccaagctcttcgcatgnagaagaggaggccgcacgaaggagacgaag

SEQ ID NO: 53731 - DNA, 101 bp, rice(Oryza sativa)
  misc_feature (71): n=a or g
aagaccacgagagttttaatacgcctaacctccacatgcttgtgctgatcgaggttcgaggccccacaaanagagcccatcatcattaaccgcacaggctt

SEQ ID NO: 53732 - DNA, 101 bp, rice(Oryza sativa)
  misc_feature (71): n=a or g
tgcctttggttgaacttaaaagcaagtacaggaaggtttcatcaattgacaaaattggcaatggttggcangaagagtatgatgcatcatccaagcaggta

SEQ ID NO: 53733 - DNA, 101 bp, rice(Oryza sativa)
  misc_feature (71): n=t or g
agggagcatctcgatcgcatatgcagctgctagctaggtagaattaattcatgaagaagagacggtgaacngcgggcggtagatcgatcaagcatggatga

SEQ ID NO: 53734 - DNA, 101 bp, rice(Oryza sativa)
  misc_feature (71): n=a or c
atctcttattaaatgagtggtggttggggagaagataataagagatggtgtttggaggtaagattgagtanaaataaaataagggatggttggtgaaggga

SEQ ID NO: 53735 - DNA, 101 bp, rice(Oryza sativa)
  misc_feature (71): n=t or c
agttttcatttattttctgcacaattgacttgactagacatgaccccattttggggtgtgtttagttccangtcaaaattagaaatttgactaaaattgaa

SEQ ID NO: 53736 - DNA, 101 bp, rice(Oryza sativa)
  misc_feature (71): n=t or c
gcaagtaaagctgaacgttcttgggcttccacttcgtcctgtaagtctttctaattcttttcttgttgggnttatttcttctgcacgcaattatgttagct

SEQ ID NO: 53737 - DNA, 101 bp, rice(Oryza sativa)
  misc_feature (71): n=a or g
caccctttctgaaataagctgcggcctgacctcataatagtgtcaaatactccatcatgttacaacttacnacagcacaacattgaaaactttgtttcaag

SEQ ID NO: 53738 - DNA, 101 bp, rice(Oryza sativa)
  misc_feature (71): n=t or c
agtatcgagaatttaagtcagccaaagaggcctagggcagagtttagtcattcggatataattggtgatcnagggcttcacaaaccaattgaagcttatcc

SEQ ID NO: 53739 - DNA, 101 bp, rice(Oryza sativa)
  misc_feature (71): n=a or g
tgaatgtattaaaagatatattttactcggagtatctactttatgcatggctatatagtttagtaggaatnattttttttcttttataaaactacatctaa

SEQ ID NO: 53740 - DNA, 101 bp, rice(Oryza sativa)
  misc_feature (71): n=a or g
cctaggatattcgtcgactctccacccaagaattcggtgcacttgttcacaccgatgaccagatagatagntagatagatcataccagtttcagcttaata

SEQ ID NO: 53741 - DNA, 101 bp, rice(Oryza sativa)
  misc_feature (71): n=t or g
tagaggctgataacaaggcactaacctgtattctcctgttcatggtgaataatcatgtgccatttatttgnaaccaaaattttggatgcaaataggtgttt

SEQ ID NO: 53742 - DNA, 101 bp, rice(Oryza sativa)
  misc_feature (71): n=a or c
caacgcatggtccaacccagaattcacggtcaaactgaaaaatgtggacagaaactacagtgcgagtgacntcagtttactgcactttccctgctacagtg

SEQ ID NO: 53743 - DNA, 101 bp, rice(Oryza sativa)
  misc_feature (71): n=a or g
aatcccaataatctctagctagtttaacttcatctctatttaatctctgttaaaaacggcttatattttgngacgaaaagactatgtacttggcatcttgg

SEQ ID NO: 53744 - DNA, 101 bp, rice(Oryza sativa)
  misc_feature (71): n=t or c
atcctgccaaatttggaatcgaggtgtgacctggtccaagaaaaaggagatagccaaatgatttagataanccctcaaattatcttaagtgtacctttgtt

SEQ ID NO: 53745 - DNA, 101 bp, rice(Oryza sativa)
  misc_feature (71): n=a or g
ccccaaatgtttccagataatccagactgtaaaaaaaagtactacaaaatcagggggacgcggttgaaaangcttggaataatagcagtagtaccgacgtg

SEQ ID NO: 53746 - DNA, 101 bp, rice(Oryza sativa)
  misc_feature (71): n=t or c
tgctcctgtgccatgtgtgtgatgtgtcgataatggccctttttccgttggactttcagtgcatgtccagncaaacagagcaggtgttcagcttccttgta

SEQ ID NO: 53747 - DNA, 101 bp, rice(Oryza sativa)
  misc_feature (71): n=t or c
aagagaccatagaaggcaatagatctttaagctctagagagaaaagagagggaaggtcggccaggacttanagtgacaatgtcttctccggtgatggcgca

SEQ ID NO: 53748 - DNA, 101 bp, rice(Oryza sativa)
  misc_feature (71): n=a or g
ccaaaaggcatatttacttattcaagactatcttacggagaactgaagattctaatgcacctgtttatcantgcaacaattattacctaccactgactata

SEQ ID NO: 53749 - DNA, 101 bp, rice(Oryza sativa)
  misc_feature (71): n=t or g
catatccacatccatacataggagaactcacaactgtcaggtttgtacatgaagcttggtaggtgcaaacnctatacctgtcgcaagtgagaggttacctc

SEQ ID NO: 53750 - DNA, 101 bp, rice(Oryza sativa)
  misc_feature (71): n=t or c
atagagagtaagtcagacctgtcataagtggaagaggtcttgtagaatttgcctttgtgctcatcctcatnacttacctcacaatagttgacattcgttgg

SEQ ID NO: 53751 - DNA, 101 bp, rice(Oryza sativa)
  misc_feature (71): n=t or c
tccagcgtggcaacaataactcatgacaacccattatgtttgtaaccaagagtaaatagaagagtagacantaaagaataccgtaagtaataaattttcag

SEQ ID NO: 53752 - DNA, 101 bp, rice(Oryza sativa)
  misc_feature (71): n=a or g
gactcaagtcaggtccattgactttccagtctataccgttacgccaatctcggctggcccaattatcatcnggaacgagatagatacggcaatgattgaga

SEQ ID NO: 53753 - DNA, 101 bp, rice(Oryza sativa)
  misc_feature (71): n=a or g
ttaagctggtgttcaagtcgtatgttgtgtgaacagcactgaatacgatggcactgctattcagcaatatnctaattatataaaaaatattatctgtccta

SEQ ID NO: 53754 - DNA, 101 bp, rice(Oryza sativa)
  misc_feature (71): n=a or g
aggacagcatccaaggccgaaccaagccccaatgacatggaagaaattcaggactgagcgaactagcaagncagtgatggcggttgaagaagtgcaggccc

SEQ ID NO: 53755 - DNA, 101 bp, rice(Oryza sativa)
  misc_feature (71): n=a or c
aaaattttaacgcgaaatgacatttttgtccaaagggtttcataactctagccaaccctcgaactcatcancctcatgataaattcagtcttatcttcaac

SEQ ID NO: 53756 - DNA, 101 bp, rice(Oryza sativa)
  misc_feature (71): n=a or g
ctggtgtaacagtgtgtgtacatagcattttaattgttgtggcatatggatgcttggaggggggcagttanttgtgggccccacaaggcagtaggttccaa

SEQ ID NO: 53757 - DNA, 101 bp, rice(Oryza sativa)
  misc_feature (71): n=a or g
atcctttactatggcgttgccgcacaaaatcatttaactcaacaagtcttggggatccgcttcttaactcnccaatctaaagaaagataagctgcaagtgt

SEQ ID NO: 53758 - DNA, 101 bp, rice(Oryza sativa)
  misc_feature (71): n=a or g
gtgggctaaagcccattcattaattccaacagcatactggagtatgcattctgaattttggtggtgtgtcntgatatagcatattgcatgccatcaaagga

SEQ ID NO: 53759 - DNA, 101 bp, rice(Oryza sativa)
  misc_feature (71): n=t or c
gcatgacgcgtggagactttaccaatccaatattccaatgccgcgctccacgtcggctcgcttgatctttngcaactcccggctcactccgctcagcttaa

SEQ ID NO: 53760 - DNA, 101 bp, rice(Oryza sativa)
  misc_feature (71): n=t or c
ctttgtactgaaaatcataaacacctactacacatatagtacacttcgctagagtactgatattgagggcntatttggtagagctccagctccacctcttc

SEQ ID NO: 53761 - DNA, 101 bp, rice(Oryza sativa)
  misc_feature (71): n=a or g
acgcgcacacagcaaagcaaaccaaagcaaagcttcgtttccgctgccccccacaggccactggacgaggnagagcacgcagcttcgcctctaccggcggc

SEQ ID NO: 53762 - DNA, 101 bp, rice(Oryza sativa)
  misc_feature (71): n=t or g
cagtagtttttgggaacaggttcaaagcagagggaatgcagatctacacatttcgagaaacagaacgacanaaaactaaaatacaggaagaattcaacata

SEQ ID NO: 53763 - DNA, 101 bp, rice(Oryza sativa)
  misc_feature (71): n=a or g
tcactcattcacacagcatgcatctacttttggtccttcacacacttcatcgagaacatattcagcattcntttttagacgattggccatgtctctacccc

SEQ ID NO: 53764 - DNA, 101 bp, rice(Oryza sativa)
  misc_feature (71): n=a or g
ttttactattcggaattaaaaattaaaagttgaggggacaaagttctaggaaatcccaaaccaagttttcngacagttttaacattagacatatacttttt

SEQ ID NO: 53765 - DNA, 101 bp, rice(Oryza sativa)
  misc_feature (71): n=a or g
taatataaaacatgtaattgcaggggggaaatgggtagtagcaaaatatttgaaacaaaaatgcagccccntgtgtatctggtacttaaaatttcagtaat

SEQ ID NO: 53766 - DNA, 101 bp, rice(Oryza sativa)
  misc_feature (71): n=a or g
tggtgctcccggggacacagctggaacattctccgtttcatgtgcagctgtttctggagtaagaagaacantgagctcttccttgtctatgaattgatgac

SEQ ID NO: 53767 - DNA, 101 bp, rice(Oryza sativa)
  misc_feature (71): n=a or c
taaccagatgaaccaagcaacctgggaagatgcatcaaacaatttcaaaatataagcaaagacataggtanaaatactagttaggtacaacagatcagtaa

SEQ ID NO: 53768 - DNA, 101 bp, rice(Oryza sativa)
  misc_feature (71): n=a or g
cccggttgattccatgtcaagccgtgtcagggcgcccgagatttttattcccctaactttagtcccaattngtattactaaccgggaataaaaatcaaaac

SEQ ID NO: 53769 - DNA, 101 bp, rice(Oryza sativa)
  misc_feature (71): n=t or c
atggtaaaaaaatctaattcgtaatgttaagaaaacccggatagaacgaccctaaccctcaatattaaaancggtacagaccgactcctatggcagtatta

SEQ ID NO: 53770 - DNA, 101 bp, rice(Oryza sativa)
  misc_feature (71): n=t or c
agggcagaccaaagaggggagacatatcgtccaatatagaactgacttctcccacaagagcaaaaagtaanagtatggccagggttaggatgtatcgagga

SEQ ID NO: 53771 - DNA, 101 bp, rice(Oryza sativa)
  misc_feature (71): n=a or g
taagagaatgatttttttttacctggcttctatatccaacccgatatatatatgcagccatttaaattggnaacttagccccgcaaacaacccaatgtgaa

SEQ ID NO: 53772 - DNA, 101 bp, rice(Oryza sativa)
  misc_feature (71): n=t or c
tgtcacttattattattattgttcagtaaattgattattctcagtgcgtacttcctccaatagaaagatgntcttttttaaaatatgtttctttttttttt

SEQ ID NO: 53773 - DNA, 101 bp, rice(Oryza sativa)
  misc_feature (71): n=t or g
ggggggaaatggtgttttagatgagtaaatatattgtacagtgctctgctttcatggcatccatgcatgtnagtcagggatggatcactcttctcagttct

SEQ ID NO: 53774 - DNA, 101 bp, rice(Oryza sativa)
  misc_feature (71): n=t or c
ggtgaggtcactctccctgggcgtctcgcaaacgtggacaaaggtcaaacttctactagctgcatgcaagnctgcagactgtagtcgttgcctgttgaaaa

SEQ ID NO: 53775 - DNA, 101 bp, rice(Oryza sativa)
  misc_feature (71): n=t or c
tgccttttgcatcattttatcttcttcacaatttgtgagtcaagttttcccatgttccatcatagtgtttngtgacttactccctctatcaaaaaaaaatc

SEQ ID NO: 53776 - DNA, 101 bp, rice(Oryza sativa)
  misc_feature (71): n=a or g
tggcattatgttttaacagtgcaggtgcatcaattcattcagggtaattctaaatttactacgggactagncgactaactatacatttgtcgtcaaatttt

SEQ ID NO: 53777 - DNA, 101 bp, rice(Oryza sativa)
  misc_feature (71): n=t or c
cgacctccccctcgcgcgcgcagcctctgagctttgccaagtttactgtacttgcaccctactccctccanatctgtaaaggaagtcgtttaagaaaatgt

SEQ ID NO: 53778 - DNA, 101 bp, rice(Oryza sativa)
  misc_feature (71): n=a or g
gcaatcgttgagttagggttcaggttgaatctcgggctattactaaggctgtgttcggtaggaaggatagnaactaatctcttctatacggaaaacagagc

SEQ ID NO: 53779 - DNA, 101 bp, rice(Oryza sativa)
  misc_feature (71): n=t or c
gtgatgtgaatggaacagtgaagagtgtaatgtctaagtcgggacagtattttaaagcccataaaattctnttcttaggagatcatagaagaacttacaat

SEQ ID NO: 53780 - DNA, 101 bp, rice(Oryza sativa)
  misc_feature (71): n=a or c
ttttccttctttgttttcctcttccctctttttttttacgtttggcaattaaccttttattcttttcgccngctcctatctttcatctagattcttgcgac

SEQ ID NO: 53781 - DNA, 101 bp, rice(Oryza sativa)
  misc_feature (71): n=a or c
ttcgcatgtcatattgtaagggcatctacaatgtggatgaaaatgggtagtaagacccctacctactttancattgtggagatgggtagtaaagcaggtaa

SEQ ID NO: 53782 - DNA, 101 bp, rice(Oryza sativa)
  misc_feature (71): n=t or c
gctctgcatgactgcatagctctattcatcgaaataattacggagtaagaatttaacgtgtcatgtctctngccaacaactactggcaattatcatatctc

SEQ ID NO: 53783 - DNA, 101 bp, rice(Oryza sativa)
  misc_feature (71): n=t or c
caagcttttgcactatatagcggcaagtaaaatcctgaaatatatcttctgtgtactggagacaaaatatngttatgtaagcacgacaggcactgggagtt

SEQ ID NO: 53784 - DNA, 101 bp, rice(Oryza sativa)
  misc_feature (71): n=t or g
cagttaagtacagaaaatctgaatggattcatgtgagagtgaataaataatcatcactaagaatcaagcanaatcaagcaggaaaatgcatgtttgattcc

SEQ ID NO: 53785 - DNA, 101 bp, rice(Oryza sativa)
  misc_feature (71): n=a or g
ttaacggtgtcaaacatttcaaaacggagggagtaatagagatgtttggttggttaggcaaattttgatangggcaatcccaggcccaaagatttcgccga

SEQ ID NO: 53786 - DNA, 101 bp, rice(Oryza sativa)
  misc_feature (71): n=a or g
gacactctagtctccaaaatgtattttcctctcttggcatgttcgctaaggacctgttcggtttggagagnattgacgggaaataattctacactaaaata

SEQ ID NO: 53787 - DNA, 101 bp, rice(Oryza sativa)
  misc_feature (71): n=a or c
ctctacaatgtcaactatgatgtataccagcaccagctgcaggttttgtgttcagtagaatagaatgcttntgtcgatttgtacaagctacaattaactag

SEQ ID NO: 53788 - DNA, 101 bp, rice(Oryza sativa)
  misc_feature (71): n=a or g
taacctgttctcttgtaaacagctttcagatagaaaaggagaaccagtgaactacccgtttcataattgcngggcaagcacatcaaaactgcctgctcatg

SEQ ID NO: 53789 - DNA, 101 bp, rice(Oryza sativa)
  misc_feature (71): n=t or c
atttatggcccatgtagtggcccagaacgttcagattttgttgcttggctaaagaatttttcttttgggtnagttgataacatgattctcctaggagactt

SEQ ID NO: 53790 - DNA, 101 bp, rice(Oryza sativa)
  misc_feature (71): n=a or g
cctgcaccagccattagccaagaagaacggccgtgtgtctaagagtctgaaacagtgaaactgatccaagnagtgcagctccgaagctgatccagaaaatc

SEQ ID NO: 53791 - DNA, 101 bp, rice(Oryza sativa)
  misc_feature (71): n=t or c
gccatggaggccattgttccggcgagtctcttctcgtgttttttctcttgttcttcagctataatgtccangtttatttgttgatttctcttcttgttttt

SEQ ID NO: 53792 - DNA, 101 bp, rice(Oryza sativa)
  misc_feature (71): n=t or c
agtgggtcatgtgagctacaattgtcccactcctcggaacattggcggcagggggttaattcgaggagggnatggtggatttggtggaacccgtggtggat

SEQ ID NO: 53793 - DNA, 101 bp, rice(Oryza sativa)
  misc_feature (71): n=a or c
tgatcaacaaatgctggatcttgacactagcagaggggaaccagaacataacacaccaaaaaaaaaaaccnagcatttggcatactagttttttgttctaa

SEQ ID NO: 53794 - DNA, 101 bp, rice(Oryza sativa)
  misc_feature (71): n=t or c
accgacgtgtcgagcagccaacggcagtgagtgcgtagcgagagctgatgagcaatcgcaatgcatgatanatcgaggagatatactgtcacgcctagaaa

SEQ ID NO: 53795 - DNA, 101 bp, rice(Oryza sativa)
  misc_feature (71): n=t or c
tttgcctacaagttttgcccatggtactgttttactatactactgttcagccaacagctagtcagcgtgtntacttcgtctgatctgccacgcgtcaacga

SEQ ID NO: 53796 - DNA, 101 bp, rice(Oryza sativa)
  misc_feature (71): n=t or c
accagggaccagatccaaggcagcgcgatgaatggagatgagcaatgtgctgacgatgacgacggggcgcngcaatgtgctgaggacgacaccgtcacaat

SEQ ID NO: 53797 - DNA, 101 bp, rice(Oryza sativa)
  misc_feature (71): n=a or g
tcaagcagtctacacgactccgtattaactagagatgatatagcgggggaaaaaagtttcccttacccatncattatgtattcctacatagactctttcgt

SEQ ID NO: 53798 - DNA, 101 bp, rice(Oryza sativa)
  misc_feature (71): n=t or c
tgtggaccgtaaatcctcactaaattcttcatggaagcacatcggtagtgtggcaatagagtcaagtgtanatgttgctcatcagggttattgttttattt

SEQ ID NO: 53799 - DNA, 101 bp, rice(Oryza sativa)
  misc_feature (71): n=t or c
tggttgagtcccacaaacaatgaacccacaatgatcattgctatggttgttgactgacccctttggcctcngatctcggttgttgcggcgttgtgcattgg

SEQ ID NO: 53800 - DNA, 101 bp, rice(Oryza sativa)
  misc_feature (71): n=a or g
catactaccacataatcgaaccgaataagttgtgcataacttatttgaaatttctgccaccctacacaatngagaatccaatgagtttgcaaacactgcat

SEQ ID NO: 53801 - DNA, 101 bp, rice(Oryza sativa)
  misc_feature (71): n=t or g
gcagttgagattatattgtacaggttgggaaaccttgcaagcttgtttgttacaccatagcaaattctctngtagcgatcacatcatgcgcattctcctct

SEQ ID NO: 53802 - DNA, 101 bp, rice(Oryza sativa)
  misc_feature (71): n=t or c
gcttatcctattaggggcgggcactatttattggttgttatggcttcgcatgaacgatatggtgttttganaaaagaaaaagctcttcttccttacgggtt

SEQ ID NO: 53803 - DNA, 101 bp, rice(Oryza sativa)
  misc_feature (71): n=a or g
agaaataatattgtactcctacgtatcgaagtcatgcgaaactcatgcatggccttttcacgtttttcttnttaagaaaccccaaacaacaagcttctaaa

SEQ ID NO: 53804 - DNA, 101 bp, rice(Oryza sativa)
  misc_feature (71): n=t or c
ggagaagaactggaaccgattaacaaagagctcatcactagtacaagaagctcagtttttcacgaacgcgnaaaaggattgcgcgtcaatatattacggtg

SEQ ID NO: 53805 - DNA, 101 bp, rice(Oryza sativa)
  misc_feature (71): n=a or g
ttggctgttctttcagtcttgccaagtgtgttcatgcagggagcaaaccactgtggtcagagaagatagcncagtataacttgattgatgcatgcatccaa

SEQ ID NO: 53806 - DNA, 101 bp, rice(Oryza sativa)
  misc_feature (71): n=a or c
gctgccagtcgaatggcttgagtttgagacctctaaagctcgtagactctaatttagtgattgcttcatgncacgaattatattggtgttgtgatttatat

SEQ ID NO: 53807 - DNA, 101 bp, rice(Oryza sativa)
  misc_feature (71): n=t or c
tcttttctattttttgtaatttgtgtcatgggtaatttagctacagaagttgggttgtggagcacgcacgntttctaaacggttaaacgatgtattttttg

SEQ ID NO: 53808 - DNA, 101 bp, rice(Oryza sativa)
  misc_feature (71): n=t or c
ggaaattgctcatgttgaatagcatgttctagctgctggcctcgaatgaaatcgataatttgataatgacntgttaagttctaactgctcccttagctaat

SEQ ID NO: 53809 - DNA, 101 bp, rice(Oryza sativa)
  misc_feature (71): n=t or g
ttgtatatgttgtgattgtgaggtactcatggaatattcatgttctaagactttgcctggcactggaaatnttcctttgtttttattctcagaatacatgg

SEQ ID NO: 53810 - DNA, 101 bp, rice(Oryza sativa)
  misc_feature (71): n=a or g
tgttgagccatataaaagaaaacaaatccgatgaactaaagtcggcacaactctctctcctgccctaatancatcatccagatcatgctgcgaggtactct

SEQ ID NO: 53811 - DNA, 101 bp, rice(Oryza sativa)
  misc_feature (71): n=a or g
catgatattgagctcacaaaacctcttctcatctaatgacttggtgaatatattggccaattggctttcgnttctcccatgggagaggacaatatctccgt

SEQ ID NO: 53812 - DNA, 101 bp, rice(Oryza sativa)
  misc_feature (71): n=a or c
accaaacactaggtgtgatccgaaatacacatctggctagaggctttgactatagtgtttgggaaattctntgctgtgtgttctttcattaatgccctaaa

SEQ ID NO: 53813 - DNA, 101 bp, rice(Oryza sativa)
  misc_feature (71): n=a or g
tgctgcagctctactgggtgaacaattactcacatgtcaccagaactctagcaatgaagcagcatattggnacctgaaaagatttggatctcaccaatgtg

SEQ ID NO: 53814 - DNA, 101 bp, rice(Oryza sativa)
  misc_feature (71): n=a or g
ggtctcggcagggaagacgaagcggcacttgtttagcgttttttgttagggtatcgggaggtgctaatggncctaggcctatacagtgctttcagcccaac

SEQ ID NO: 53815 - DNA, 101 bp, rice(Oryza sativa)
  misc_feature (71): n=a or g
cgtcattaaacatcacttcagggggaaaaacatcctctgagaataaatgatttgtactattaaacccatcnccaactaatactaatcactggcaactaaaa

SEQ ID NO: 53816 - DNA, 101 bp, rice(Oryza sativa)
  misc_feature (71): n=t or g
aaatagttgtcacaaactagctgttggaatgctgccaaaagtaaaaaatagctgttgcaaactagctgttngaatgctgccaaaagtaaaatatagctgtt

SEQ ID NO: 53817 - DNA, 101 bp, rice(Oryza sativa)
  misc_feature (71): n=t or c
ccatagggcaaacgatgaggccccaagttatcaggcaggcatcttttcttcatagtactagatgaagcccngcgcgttgctgtgggagttttttataatat

SEQ ID NO: 53818 - DNA, 101 bp, rice(Oryza sativa)
  misc_feature (71): n=a or g
ccgcatgcttttaggatgttggggacattgaccttcagattgacgagggctttcaccttgatggcctcgcnaaggcagaaagcggcggtgtcgctcgggag

SEQ ID NO: 53819 - DNA, 101 bp, rice(Oryza sativa)
  misc_feature (71): n=a or g
atttgtgtgtgtcgcaatgttggctgtttctgaaaagaagtctcggtctttgcctctgatgatgacatctngttggccatgaggcgtggtgtggttgagag

SEQ ID NO: 53820 - DNA, 101 bp, rice(Oryza sativa)
  misc_feature (71): n=t or g
gaacttgtctcttgcccagttgcattacaaacttggccaattgtcatcctaggatatgattgaacgaaagngttattatcacgatgagtcatgaaacccat

SEQ ID NO: 53821 - DNA, 101 bp, rice(Oryza sativa)
  misc_feature (71): n=t or c
acttgggcaaagaacaagcactgaatagaaccgaaaaatgacaggaatcggaaaccagaggagaacaaacnatacaagctgcaccacaagggctccacgtt

SEQ ID NO: 53822 - DNA, 101 bp, rice(Oryza sativa)
  misc_feature (71): n=t or c
tctttggtggggacccaggaaaataagtcattttagacattggcattgtctacatgcatggtactccctcnagttccatattaattgacgttttagacaag

SEQ ID NO: 53823 - DNA, 101 bp, rice(Oryza sativa)
  misc_feature (71): n=t or c
caagcacaccatcgcacacatggcaatccgttatctttgttttcttctgttgtccccttttgtgcaacaanactaacagttttgtaaaagaaaccaacttg

SEQ ID NO: 53824 - DNA, 101 bp, rice(Oryza sativa)
  misc_feature (71): n=t or g
aatgacattccttttgtcctagtccccgataacaaagtgttaaccggtttcattttcatcttgtgcaacancactgttatctgttgacaatgcattgatac

SEQ ID NO: 53825 - DNA, 101 bp, rice(Oryza sativa)
  misc_feature (71): n=t or c
ctgaaaagccacagccttataagccaaacgatgggcttcggctgaaaagaaaaggcccaagcaagccatcngatggcagcctcatattaatccatattttt

SEQ ID NO: 53826 - DNA, 101 bp, rice(Oryza sativa)
  misc_feature (71): n=t or c
acagccacaaaccttgatggaggcttctgcacaaacagaggaaacaatttacaaactgaaaggaaactganggtagcattacaaacaacaaagtgcagaat

SEQ ID NO: 53827 - DNA, 101 bp, rice(Oryza sativa)
  misc_feature (71): n=t or c
caaaagaaaattcatgtgtttctaatggagcctaatttggggcatcaattggttccgaattatccaatatntggatctagagagagtaacgaatataggag

SEQ ID NO: 53828 - DNA, 101 bp, rice(Oryza sativa)
  misc_feature (71): n=a or g
gtcaactcgcgggttggcccgcttgcatccatagtcttccatagtcttcagtacttgactcgatacccgcnttggatgagcctgcatcgacttcctccttc

SEQ ID NO: 53829 - DNA, 101 bp, rice(Oryza sativa)
  misc_feature (71): n=a or g
caacccatgaccaaaaaccaccctacgacagcctagtgcccttgagttattgacctacaaaggaaaacttngagcacaagagctccagccgggcaccaaag

SEQ ID NO: 53830 - DNA, 101 bp, rice(Oryza sativa)
  misc_feature (71): n=a or g
cccaggaccagcccaaaatatgggtctaccctgcttcctaggcggacaaggattttctacacctagtgccntggcacctatcatttacatgtggctcaaat

SEQ ID NO: 53831 - DNA, 101 bp, rice(Oryza sativa)
  misc_feature (71): n=t or c
taattactatggcaagcaaaaactcctccactacttctaacagcgacagatgctacacatatactccctcngttaatataagggattttgagtttttactt

SEQ ID NO: 53832 - DNA, 101 bp, rice(Oryza sativa)
  misc_feature (71): n=a or g
agccaaacaaggcgcattctctgttgttggcttacagatacatctatgcagttgcaggaaaaggacagctngacatgcccttagtacatttactcttttaa

SEQ ID NO: 53833 - DNA, 101 bp, rice(Oryza sativa)
  misc_feature (71): n=t or c
acagacctgtgtgaaaatcgatttctataggtggcagggttaagaataccacatacgaaaataatctttanggacggtcgtttacccactaatggaaatga

SEQ ID NO: 53834 - DNA, 101 bp, rice(Oryza sativa)
  misc_feature (71): n=a or g
attttggtgcacgaacttatcaagtgtgtgcgaactagggctaaaatgacattacattgttaatcttgatnatttaggtgctgattaggatactagacgta

SEQ ID NO: 53835 - DNA, 101 bp, rice(Oryza sativa)
  misc_feature (71): n=a or g
aaaattgctacttttccatgcagttggtgcacccgtgtgtgaaaatcatgtgtgggtgcttatatcatccncacgcaataataaaaatccaaaaaaaaaat

SEQ ID NO: 53836 - DNA, 101 bp, rice(Oryza sativa)
  misc_feature (71): n=t or c
ctaatacaggaaattcaggacttaaatgaaccataaaacaatatgacttcccatattgtaatcagagggantacaatgagtgaacacattaatcattttaa

SEQ ID NO: 53837 - DNA, 101 bp, rice(Oryza sativa)
  misc_feature (71): n=t or c
gaacatcattgtccattgatcttatcaaaacatgcctgttctgttatctacataaggccttgtttagatcnaagaaattttgacaaaaaaatgttacatca

SEQ ID NO: 53838 - DNA, 101 bp, rice(Oryza sativa)
  misc_feature (71): n=t or c
gccagaaaaatcctattgagacagcaaaaaaagtctctacgtacgtgcctatattaattaagacgttgtgnaggtggttctataaaagcgtctctatattt

SEQ ID NO: 53839 - DNA, 101 bp, rice(Oryza sativa)
  misc_feature (71): n=t or c
gaaaaatctaagtctaaacaaacaaatagctttttcgtttgactttctaaagccataaaccattcttacantattaagtcaaaagctatgttagagaagct

SEQ ID NO: 53840 - DNA, 101 bp, rice(Oryza sativa)
  misc_feature (71): n=a or g
aaaatttattatgttgctgccgttgttgttttgttcttgctatatgctgttcttcaacctcaaccataccnctttacatgttgaaagtttgatttgttcat

SEQ ID NO: 53841 - DNA, 101 bp, rice(Oryza sativa)
  misc_feature (71): n=t or c
ggaaaggggtaggagggggcgagggctaagatgacaagaaatttgagtaagagatgatggataagagacgnagtactctaatatggttttatttacagaca

SEQ ID NO: 53842 - DNA, 101 bp, rice(Oryza sativa)
  misc_feature (71): n=t or c
cgcccttctggctgaggaaggagcggaagagaggggagttcacgtcgtagatcatcttcgcctttgctgcngccgccgccgccgccggggcaagagtcgct

SEQ ID NO: 53843 - DNA, 101 bp, rice(Oryza sativa)
  misc_feature (71): n=a or g
actatagtactttcttactaaataagcatatcaggagatattaccgtcgcagaatgatgaaccacctccantaactcagctgacccaagactacgggtaca

SEQ ID NO: 53844 - DNA, 101 bp, rice(Oryza sativa)
  misc_feature (71): n=t or c
aagttgcagcctgtgagttatatccctccttccccgaccactactactttctgtccctccatccccagctncctccctccctccgctcccttgacatggat

SEQ ID NO: 53845 - DNA, 101 bp, rice(Oryza sativa)
  misc_feature (71): n=a or g
cctgcacataacaaaagcataggaacataggattaagtattgcagcacactgtaacacaaaaggttacctnacctttttctatgataaaaaagtatttttt

SEQ ID NO: 53846 - DNA, 101 bp, rice(Oryza sativa)
  misc_feature (71): n=a or g
atgaaaagttaaggatcaccgatcggtaaattagatcgacatccaaagcttctaggtaaaacacttctcgncaaccctctccaactgctgacatgccacag

SEQ ID NO: 53847 - DNA, 101 bp, rice(Oryza sativa)
  misc_feature (71): n=t or c
tgggttctgtgcaggcagaaacttgatgtttggtgctcagacagcgaatacatttaccatccatatgcttnaggaacttctctcttcgagattgaatgcga

SEQ ID NO: 53848 - DNA, 101 bp, rice(Oryza sativa)
  misc_feature (71): n=t or c
gactactgctttgtgaaattgctgttgggaatttgggttcgatgtttggaacatcaatagctgacgggatnagctaggcctgggtggccgtttgaaagttg

SEQ ID NO: 53849 - DNA, 101 bp, rice(Oryza sativa)
  misc_feature (71): n=a or g
atcgtcgagcaagtttgatggaaagctgatctgcaaggctgatgatgggtctccccagatctacaccgganttgaagaaggcagcagtaacaacggcggcg

SEQ ID NO: 53850 - DNA, 101 bp, rice(Oryza sativa)
  misc_feature (71): n=t or c
atgcatgtactttccaaaagagtgtgaacgtgattgagtttccaattttgtgatcgtacaaaaattaagcnccctaatttcgccccctaatttcggtgtga

SEQ ID NO: 53851 - DNA, 101 bp, rice(Oryza sativa)
  misc_feature (71): n=t or c
tcacatttacactcactataacaacaaaaataaccggcatgccctagtttggacaatattatgtgttaagnctaatagacaactgcatttaatttttttgg

SEQ ID NO: 53852 - DNA, 101 bp, rice(Oryza sativa)
  misc_feature (71): n=a or g
agggactatcatggctcagttggagaggcgggagccggagctagcaattacccgaagcatgctattacctnggtaatagcggcatccaggggcgcgccata

SEQ ID NO: 53853 - DNA, 101 bp, rice(Oryza sativa)
  misc_feature (71): n=a or g
gacgacccaaaactacttttttcatgtggcatctaagctcggatatggatcgacgtcggacgatatggttnacgcttgatggacaattataagtccttata

SEQ ID NO: 53854 - DNA, 101 bp, rice(Oryza sativa)
  misc_feature (71): n=a or g
acatccaagaacatgggaacactagaatactaagagcactaaaatcactaaaaaatagatctagcgaaggngaggccaccgcccgtcgctgcctctgcctc

SEQ ID NO: 53855 - DNA, 101 bp, rice(Oryza sativa)
  misc_feature (71): n=t or c
tcttgcgcggtttcatcatgcctctgcctaactgctgccagatcggagagcttcatctcatgggtcccacngtagaagtagctatgtaattgcttctccaa

SEQ ID NO: 53856 - DNA, 101 bp, rice(Oryza sativa)
  misc_feature (71): n=t or g
tattacgttatttgcaaggaactaagcattacatgctcacatatataaaaggtcagataaacttgaggtcntaggttattcagacgctgactttgcagggt

SEQ ID NO: 53857 - DNA, 101 bp, rice(Oryza sativa)
  misc_feature (71): n=a or g
aaaaaattacaggtgatcatattactgtcacaaaggccaagcacagcggtacgtatcattttcaggacgantcggcgttgcactaatcacatcgatggtgc

SEQ ID NO: 53858 - DNA, 101 bp, rice(Oryza sativa)
  misc_feature (71): n=a or g
gttcaagaaagtccgtgcacagatatggctaattgctggactcgaagtcataagtgggactaatcaagatngttcgtcactgtatgttgttggtttgaagg

SEQ ID NO: 53859 - DNA, 101 bp, rice(Oryza sativa)
  misc_feature (71): n=a or g
gttgttccacgtccaaattagaggggatcttttgctgatttgtaaatttaaacacgctgacgacgattctncagagaatggcagttttgaaccacagacgg

SEQ ID NO: 53860 - DNA, 101 bp, rice(Oryza sativa)
  misc_feature (71): n=t or c
ttgttgattattactgatctagtgtgtgaagatttgttgagtgtttcaacaatgaaaacgaagcgttcggnatggattaagcgttcagaaatgaaaacgcc

SEQ ID NO: 53861 - DNA, 101 bp, rice(Oryza sativa)
  misc_feature (71): n=t or g
tatcatcttcaccatcgtcgttgacacaaacaggatcgccggtcgtgtgaaacaagcagacgaaggagccnattgttggcaacttttttttgacaagaaga

SEQ ID NO: 53862 - DNA, 101 bp, rice(Oryza sativa)
  misc_feature (71): n=a or g
tttccagcagagaaggtgacattggcaactcccgctctcattttattatgttgccaagtaggatatgtacntggttgatccgtgtatatccaacaatccgc

SEQ ID NO: 53863 - DNA, 101 bp, rice(Oryza sativa)
  misc_feature (71): n=a or g
gacttctcttaccgccttcacgacggacctcttctcttcgcttgccattatttcggacaaagttttacttnaggtgttgaataaactaatgtataaaagga

SEQ ID NO: 53864 - DNA, 101 bp, rice(Oryza sativa)
  misc_feature (71): n=t or c
cactatgaacgctcgcactaacgagcacacgactcaagagctacaaattgccgtcattttttaagacctgncctcttgtagagcaagtaggcctctaagtc

SEQ ID NO: 53865 - DNA, 101 bp, rice(Oryza sativa)
  misc_feature (71): n=a or g
tatatatatatacggacgctcatgtgggatatcatattagagctccaaaggggacatataagtatttgtcnctttttaagatgcgataattaaggatttgt

SEQ ID NO: 53866 - DNA, 101 bp, rice(Oryza sativa)
  misc_feature (71): n=t or c
agcaacttgtactttcttggagccttgctgtgcacctacttaaggaaaaggatatacctagtaactttttnttactaaatttttactaacactgttatgct

SEQ ID NO: 53867 - DNA, 101 bp, rice(Oryza sativa)
  misc_feature (71): n=a or g
tgtgcatctgtcttttccccctttttttggccatgcttgtatccatgtatgcaatattattgtagcttgtnggtaagggttattcgccggtagctagacac

SEQ ID NO: 53868 - DNA, 101 bp, rice(Oryza sativa)
  misc_feature (71): n=a or g
tcatgcatatacgtacatgcacgcctactttccttcctttttaattgaaatacatagtccggtttgaaatncatcttatgttgctgatattgtaaaatgca

SEQ ID NO: 53869 - DNA, 101 bp, rice(Oryza sativa)
  misc_feature (71): n=a or g
agcctggcctggtaaaagcccatgttggtatcatggcccgttcaagggatcctttttgtttttttttcctntaggatgaaatttttgctttcgaaacaacc

SEQ ID NO: 53870 - DNA, 101 bp, rice(Oryza sativa)
  misc_feature (71): n=a or g
ttatggaaaggagttgttctggtcttccatcttgatgacatatatatgcatgcataatggttttctacgcncaatatatatgcatgagcatcgatcgccaa

SEQ ID NO: 53871 - DNA, 101 bp, rice(Oryza sativa)
  misc_feature (71): n=t or c
cggttattttgtcatcgcctttttcccttttattcatccgtctttttgtccctatttttttttttgcatgnggaagggtgtccctattttttattcgtatt

SEQ ID NO: 53872 - DNA, 101 bp, rice(Oryza sativa)
  misc_feature (71): n=t or c
tcctgagacaaaacatccccaatgccagtgtcacatgtatcagtctcaatgacaaaaggtttactaaaatnaggcagtgacaaaactggggtagtgatcat

SEQ ID NO: 53873 - DNA, 101 bp, rice(Oryza sativa)
  misc_feature (71): n=t or c
acacgatatgtgtgctctcatttacggctattttttttagtgataggagatgtacctatcgacagcaagangtctgtggtgatttcgtcaatctcaagata

SEQ ID NO: 53874 - DNA, 101 bp, rice(Oryza sativa)
  misc_feature (71): n=a or g
tgacgagttactacatcttgtaagagttgatttaaatcctgaataaagatctccccttttacccgaaaaanaaatatcaaggtgctagccatcttagatat

SEQ ID NO: 53875 - DNA, 101 bp, rice(Oryza sativa)
  misc_feature (71): n=a or g
cagtttcagtactatcacaaaatctcaccattttgacatcgttagcataaaaccacgagagactttaaaantaggagtactgtatcctgccataaaaggca

SEQ ID NO: 53876 - DNA, 101 bp, rice(Oryza sativa)
  misc_feature (71): n=a or g
cgcgcgcgcggggcggaggaattcgaaatccgaggtcttttatagagatcgagagaaggaggagaggaagnggaagggggaggctagggttatctatgcgc

SEQ ID NO: 53877 - DNA, 101 bp, rice(Oryza sativa)
  misc_feature (71): n=t or c
gtcataccgagtgtacaagcgtagtctcacgtgaaatattgcacggtaaaggtgtgaggctgctgagtgtntgttcccgacagtctgctctcgggaagctc

SEQ ID NO: 53878 - DNA, 101 bp, rice(Oryza sativa)
  misc_feature (71): n=t or g
acgtggagacaagactatacgtgtgctcagcaatttctttagccagcaaagctcaaggagcaagtcacctngattttatgttttcgcacttttgaaaactt

SEQ ID NO: 53879 - DNA, 101 bp, rice(Oryza sativa)
  misc_feature (71): n=t or c
gagagaaaatgttttttttttttgtttggactcccattcagtaagtgacatagttggttttcctcaattgncaggtcttgctttgagtacagtagtactcc

SEQ ID NO: 53880 - DNA, 101 bp, rice(Oryza sativa)
  misc_feature (71): n=a or g
cgacaatgtcgtcgaaataggcttcgacgtttcgccccaactgtggtcccaagaccttgtataccagcctngcgaatgttgcccctgcattcctcaggccg

SEQ ID NO: 53881 - DNA, 101 bp, rice(Oryza sativa)
  misc_feature (71): n=a or c
tcatttctcatgctatttgtagagcctgtttattattagattatgattattattattttgaaatgaagggnaaacatcacaaatagttaaaatagtagaaa

SEQ ID NO: 53882 - DNA, 101 bp, rice(Oryza sativa)
  misc_feature (71): n=t or c
caatgaagaaaaagctaagctggatgaattggaagccggcccaagtgcaactcaagctaacatcgatcggntaaataaccggaagatacatagctgaactg

SEQ ID NO: 53883 - DNA, 101 bp, rice(Oryza sativa)
  misc_feature (71): n=a or g
ttccattgacagcctccaccgcactgtcttcctacaccgccaagtgatgcctccctgacgtcgatcatcanccgcctccggcctcccactctcctcgaaga

SEQ ID NO: 53884 - DNA, 101 bp, rice(Oryza sativa)
  misc_feature (71): n=t or c
tacagattacatatagcgggttataacttataaaataaagtatacgggcgggcaactagtgctgatgtgtnatctaggtcttgaaactcttaaattatatt

SEQ ID NO: 53885 - DNA, 101 bp, rice(Oryza sativa)
  misc_feature (71): n=a or g
agagttgcaaaacccctactggattggcctatgccctgagtccctgatttgtatatggcgcccagtcaganctctcacactgaaaaggccaagactgcagg

SEQ ID NO: 53886 - DNA, 101 bp, rice(Oryza sativa)
  misc_feature (71): n=a or g
accttgccggcgacggccgggaacgccttgagctcctgctccaccacgagccccatcgcccggaacgacanctccgccggcgacctgtcccccgggatccc

SEQ ID NO: 53887 - DNA, 101 bp, rice(Oryza sativa)
  misc_feature (71): n=a or g
acacaggtcacagaatacaattactcacggtgttgacaaaaacacctctaattcctactctaatcttgtcncgtactacttccactgtttcacaatataag

SEQ ID NO: 53888 - DNA, 101 bp, rice(Oryza sativa)
  misc_feature (71): n=t or c
gaggtgaccatgtggaagggaagaagggattagggttgggaattgttgcacaaatctcaaagcgtataacngtctaaaattcgtaaggtttcgtaaggttt

SEQ ID NO: 53889 - DNA, 101 bp, rice(Oryza sativa)
  misc_feature (71): n=t or g
tgctcttaaccccatgtcacaggctctctctcccaagtccaggcatcatcatctcgtatgagttcatattntatggttaacaaactttactatgttataat

SEQ ID NO: 53890 - DNA, 101 bp, rice(Oryza sativa)
  misc_feature (71): n=t or g
accagtatagtgtgtttcttagcttcatccatcttatatcacaatactaggaggctgagaacatcctctcnctgggcatgcgaggcatcaggaaagtatag

SEQ ID NO: 53891 - DNA, 101 bp, rice(Oryza sativa)
  misc_feature (71): n=a or g
atgtttaatactccaaattagtcagagcgttcgttcgttgggtgattggagagaaagcacatcgttttccncgtgcacgattcccaaactactaaacggtg

SEQ ID NO: 53892 - DNA, 101 bp, rice(Oryza sativa)
  misc_feature (71): n=t or c
atgttcagctagcgggtctcactgaactgtggcccatgaaacatgctaaattgccaattgccgacatcctnccttggtctttgaggttaggcgggtctgct

SEQ ID NO: 53893 - DNA, 101 bp, rice(Oryza sativa)
  misc_feature (71): n=a or g
cgtcttaaaaccacaaacttttcattagcgtgagggttcacaagtatcactacatcgaaattcaaccgcancaaaaaaactgaactaattttttacatatt

SEQ ID NO: 53894 - DNA, 101 bp, rice(Oryza sativa)
  misc_feature (71): n=a or g
ttcaagattaaagagttcaagcaaacaatcacgaaaatatttgaaaacctgtactcctttagaaggcactngttatggtggcagtgaatttgccactgcca

SEQ ID NO: 53895 - DNA, 101 bp, rice(Oryza sativa)
  misc_feature (71): n=a or g
attttaatcaccggcttagaactgttgaacagatgggatggcacaatttgctgaacaatccagcttcgatnattcgattcatgcatatctcaatgatattg

SEQ ID NO: 53896 - DNA, 101 bp, rice(Oryza sativa)
  misc_feature (71): n=t or g
aatcgctgatacctttgcgaactgaatcgtgggctgtcggctcggctcgtcgagaaaaaactggaaaaagnagaggatctcatcaccgatcgaccgactga

SEQ ID NO: 53897 - DNA, 101 bp, rice(Oryza sativa)
  misc_feature (71): n=t or c
aaaaggctcagggccttggatgtcctgtttacatcgattaatttaggtgtacatgctaacaagacgcactnagggtgtacaaattaaaggtggttgggtgc

SEQ ID NO: 53898 - DNA, 101 bp, rice(Oryza sativa)
  misc_feature (71): n=a or g
gtgtattttatagcctttagcagctgctatcctgctattgttgctgcgtgataactcattttgctccttcnctgagtaattaaggatgttctagttttgct

SEQ ID NO: 53899 - DNA, 101 bp, rice(Oryza sativa)
  misc_feature (71): n=t or c
atttaactctgggtcgttttcgttttcgcatcagcatttcatcaaatacccatctgggaattttcccgagntttgagctgctttagaacaaggttcagatg

SEQ ID NO: 53900 - DNA, 101 bp, rice(Oryza sativa)
  misc_feature (71): n=a or g
ggcgcaagggggtggcgcaacctctctttgtccgacgagacatggtggaagggaactagggttttggtgcngtagaaccgtggaagaggacaggggcagcg

SEQ ID NO: 53901 - DNA, 101 bp, rice(Oryza sativa)
  misc_feature (71): n=a or g
ttttgttaaagaaaaaaatacgtttataactcgtgcacactcaccattcaccatattaagtactccctccntcccacaatacaagggattttaagtttttg

SEQ ID NO: 53902 - DNA, 101 bp, rice(Oryza sativa)
  misc_feature (71): n=t or c
aaaaattggatcactgatgagaaaaaagaagacaaaaaaaccagaatccaactcattcatcaactcactcntacacctacatactcattcatcaaatccaa

SEQ ID NO: 53903 - DNA, 101 bp, rice(Oryza sativa)
  misc_feature (71): n=t or c
ttattccagagcatttggtccatcatgtgcagccggaccatacagtaatacctcagattgtccctgagcanttggtgcaaaatattcaaccaaactaccag

SEQ ID NO: 53904 - DNA, 101 bp, rice(Oryza sativa)
  misc_feature (71): n=t or c
cgcttgacggccttcgtccttggtaagccttcggccggtcaccaagcttggtggcgaacccattgatcttnatcgccaggctttgcccgattcttagtgac

SEQ ID NO: 53905 - DNA, 101 bp, rice(Oryza sativa)
  misc_feature (71): n=t or c
ctcgtgtccagatcgagaaggaaacttccagatcgagccaccgtccgccgctctgccactacacatgtggngtgccttctccccgctcctgcgtcagtgcc

SEQ ID NO: 53906 - DNA, 101 bp, rice(Oryza sativa)
  misc_feature (71): n=t or c
cacgatatactagagattttaccccttccgagtaagatttcagcaattccttaactcgtagagatatttcngataatttgaggtaaatttctaacggcata

SEQ ID NO: 53907 - DNA, 101 bp, rice(Oryza sativa)
  misc_feature (71): n=a or g
gtttggtgggggcatataaatttccctatcgaccctacatagggcgggcatataaatcgccctacaatagngtaatctatgtgacgtagcatcctacgaga

SEQ ID NO: 53908 - DNA, 101 bp, rice(Oryza sativa)
  misc_feature (71): n=t or c
aggtatcggcaatcaagctagttgctttgcaatttctaacagcttccccactacaaaaagaggcagtattnaggtagctaaatcttgctggtttactacat

SEQ ID NO: 53909 - DNA, 101 bp, rice(Oryza sativa)
  misc_feature (71): n=t or g
cgtaagatacttaagactatgcatgcatgtgaaaaactgcaaaaactccaatcaatccagctcagtattanacgacctgtttagatgggactaaaactttt

SEQ ID NO: 53910 - DNA, 101 bp, rice(Oryza sativa)
  misc_feature (71): n=t or c
ctactaacacaagattacgccatgcaaccagggcgccaattatgtatgtagctgaactcccagaacagatnagcaactgcgtgtgcagaaggtgcggagtg

SEQ ID NO: 53911 - DNA, 101 bp, rice(Oryza sativa)
  misc_feature (71): n=a or c
ttccacaattgtaaacgccacagtcaggcagtcacttccaaacttcagccggcttcgaaatgaaactaaanaattgtatattcgaaataagaatatctagt

SEQ ID NO: 53912 - DNA, 101 bp, rice(Oryza sativa)
  misc_feature (71): n=a or g
gcacgtcgtacgccccaacggcggcgagcgtgtccgcctcgagttcttggaacacgttgacgagcacggtngccttgggtgtctccctgtcgagggcgtcg

SEQ ID NO: 53913 - DNA, 101 bp, rice(Oryza sativa)
  misc_feature (71): n=t or c
gtcaacattgacttgagaggaaatcatgtaaagtcaatctacatcatctatttgttacaattgccatacangtttgtaacatcctaaaaattcccaacaat

SEQ ID NO: 53914 - DNA, 101 bp, rice(Oryza sativa)
  misc_feature (71): n=t or c
ccaaccacgacgagccaagcgaacatcaccacagctagatcattagcaatccattccgatccatcaaattnctcttgagaccgtagagagagagagaggcg

SEQ ID NO: 53915 - DNA, 101 bp, rice(Oryza sativa)
  misc_feature (71): n=a or g
gttcaacgcccgcctgcgaaaatggcgatgccctaatagatccacgtatgaaaatcgattttcgcaaacgncacccttcagaccttgtaaaaaaaatttgt

SEQ ID NO: 53916 - DNA, 101 bp, rice(Oryza sativa)
  misc_feature (71): n=t or c
catcgtccggctcgaaggtttttagctctcgatccgtcgtcatcgatcctctccccaccactgttaatttnttcttcttgttttaatttcttgtataccta

SEQ ID NO: 53917 - DNA, 101 bp, rice(Oryza sativa)
  misc_feature (71): n=a or g
tacgaggagtcgtggcttatatcctaattagcgcctataaagtggagtcattggcccgtttctcgcggctnttgtttttctctgggcgcaggcctaaaaca

SEQ ID NO: 53918 - DNA, 101 bp, rice(Oryza sativa)
  misc_feature (71): n=t or c
gaacacctcaaagcgttttcggctaacgtggcgtctaagtggtgtcgacaaagttagaaaaaacataggangtcccgtcattttccctcttctttccacat

SEQ ID NO: 53919 - DNA, 101 bp, rice(Oryza sativa)
  misc_feature (71): n=a or g
atgactagtcgatggatggatgagccatgccgccatagggcattcttatacggcaactaccttcgacccgnccgggccgatcgatccttcaattcgtttgt

SEQ ID NO: 53920 - DNA, 101 bp, rice(Oryza sativa)
  misc_feature (71): n=t or c
ttacgacgttgttcttgtttcactattctggattctggttctggtaaaataaatttaagttccatgcttgntatggatgtgcaatatggtttcaatctagt

SEQ ID NO: 53921 - DNA, 101 bp, rice(Oryza sativa)
  misc_feature (71): n=t or c
agagaatatgccatggtcctttgttagagtaacagcaagatgattcgggtagatttaaggagaggagttgnagtggttattttactataagaagggcacgc

SEQ ID NO: 53922 - DNA, 101 bp, rice(Oryza sativa)
  misc_feature (71): n=t or c
aactgggtaaagcattgagcagagtatatatgctttggagtaaagtgtacctagctagatattgctctccnctactgttttattttctttttcttctggag

SEQ ID NO: 53923 - DNA, 101 bp, rice(Oryza sativa)
  misc_feature (71): n=t or c
aaaaattaaaaaaatacaaacactcatcccaattgatgagaagaaatagtgtcgtttggattttgaaggangaatcgattgaaacatatatcgacagaaca

SEQ ID NO: 53924 - DNA, 101 bp, rice(Oryza sativa)
  misc_feature (71): n=t or g
ttccttgggacaactcattcagagggcccaaactaactgaaggtccccaatggatagcaagcacaggaatnaatggatgaatgaatataagaagagggcgg

SEQ ID NO: 53925 - DNA, 101 bp, rice(Oryza sativa)
  misc_feature (71): n=a or c
aaaacttttaaatatctgaccgtcaaatcacatcgagattcgtgcgtgcatgggaaaggaaataatcaagngtgtaacaggatgaggacttgaactctcag

SEQ ID NO: 53926 - DNA, 101 bp, rice(Oryza sativa)
  misc_feature (71): n=a or c
taatttttttaagaaaaatacttttttggggggtatgttgtacgtttagctagtgttgtgatatggtatcnaatcaaactaaggtcccgttcttttatcca

SEQ ID NO: 53927 - DNA, 101 bp, rice(Oryza sativa)
  misc_feature (71): n=a or g
acacgctctcacatgtggcttagtcctggtaagcggataagggctcctagcttgttacatcattttagctntaatatcaaatttatatatataataaatgt

SEQ ID NO: 53928 - DNA, 101 bp, rice(Oryza sativa)
  misc_feature (71): n=t or c
agtaagttatacagaggtactcccttcggcacacaaaaaaaatccatattttaaggccttgtttagttcgngaaaagaaaatttttaggtatcacatcgga

SEQ ID NO: 53929 - DNA, 101 bp, rice(Oryza sativa)
  misc_feature (71): n=a or g
caccggttaatgcaagaacctccggcgaccaggccatgtagctgatggatcacacggttgagaggtctacngcatttctaatcctctgatggatttcggac

SEQ ID NO: 53930 - DNA, 101 bp, rice(Oryza sativa)
  misc_feature (71): n=t or c
attttaagttactgaatttcacttaacccccatcaatctagactgactctagacagccaaattcactaagngtgcattaattaattaattcattgttgtac

SEQ ID NO: 53931 - DNA, 101 bp, rice(Oryza sativa)
  misc_feature (71): n=t or c
tcggatgcatcaacaatcctgaatgtgctgtttcctgtacctggacattcaccgaatccactaatatacantcttgtagttgtatcacgagatatgtcttc

SEQ ID NO: 53932 - DNA, 101 bp, rice(Oryza sativa)
  misc_feature (71): n=t or g
atccaatgtctcagatcgcctctacctcccacctagcatacttccatccctcaatcgccacccttgccaanccccgcagcatcactctcgtcctctccccc

SEQ ID NO: 53933 - DNA, 101 bp, rice(Oryza sativa)
  misc_feature (71): n=t or c
aatcggcggcggcgagcacctgcaggagcggttccatatttgccggagttggagaagaaaaggtcgtggtntgcccctgggacgacggagtgctgctggat

SEQ ID NO: 53934 - DNA, 101 bp, rice(Oryza sativa)
  misc_feature (71): n=t or g
acgacgcggacggttggtgcggcgttgctcgcaccagagattcctgtacaccgtggcgaccaaaagccacncgccaccgtacgtactgggccggaacggga

SEQ ID NO: 53935 - DNA, 101 bp, rice(Oryza sativa)
  misc_feature (71): n=a or g
ccgaggttggtatctgcgggtgtcagaggtgtacaacaaagaacggagcttcaaagccatggagatggccngcgtgatcgggctgttcgccatagacgaca

SEQ ID NO: 53936 - DNA, 101 bp, rice(Oryza sativa)
  misc_feature (71): n=a or c
acggccagccagagtggtaaatcgtcctttccaaggacccatgcatgttgctaccccggaccaacactgtnaattttctggataatgtctaatgatctgta

SEQ ID NO: 53937 - DNA, 101 bp, rice(Oryza sativa)
  misc_feature (71): n=a or g
catcaccctcgtgtaatgaaatattctccacctgcaacagttgtgaaatcaaagccctgaaatgcccatcnacaacattcttcattactttcttatgttct

SEQ ID NO: 53938 - DNA, 101 bp, rice(Oryza sativa)
  misc_feature (71): n=t or c
cagccagagggagcaactaagggagagaaaaagacatcgtgggaagtcgaccggagagggagggaaatgangtgggcttgcgtagttggctagcacgatgg

SEQ ID NO: 53939 - DNA, 101 bp, rice(Oryza sativa)
  misc_feature (71): n=t or c
ggggcacagatcaatgtatatataagaccctaaatctgcaagctcctgcaaaagacaaaaggatcaccagnaactctaaccatttctagttctatcattcc

SEQ ID NO: 53940 - DNA, 101 bp, rice(Oryza sativa)
  misc_feature (71): n=a or g
tttataggcacgcgcgcacgcttggatatggaatggctgaaaatttgaagttttgggtttttttaaacaanagaagactatttaaagattgaataaaaact

SEQ ID NO: 53941 - DNA, 101 bp, rice(Oryza sativa)
  misc_feature (71): n=t or c
tccatccatccatgcatacatacatggatgcgtggcagcgtgtgcatgcggcacaagcactacctgctctncctactccatggaccatgggcatcgagcga

SEQ ID NO: 53942 - DNA, 101 bp, rice(Oryza sativa)
  misc_feature (71): n=a or g
cgatgacaatacctataggacgttcgacaaaaattaggtgccagaacattcaaaattttttttagcatttntatccaacaccagcatcattgctagcaaac

SEQ ID NO: 53943 - DNA, 101 bp, rice(Oryza sativa)
  misc_feature (71): n=a or g
tttcttcgtcgctattttttacatcacattttttggcatgcggtaagaattcggttttttccgtcatcgtnatttaatctccaaccgccactcaggtcaaa

SEQ ID NO: 53944 - DNA, 101 bp, rice(Oryza sativa)
  misc_feature (71): n=a or g
atagaaatacgatttgttgtactagattgtgttatattcttacttaaattgtttttttttttggacggagnaagaacagaaaaccgtttggaaagattaga

SEQ ID NO: 53945 - DNA, 101 bp, rice(Oryza sativa)
  misc_feature (71): n=a or g
tcacctcatcgtcggctggtggtggtgaggtggggagcctctgccaccaccattatcaaatgctaacacgncggagccagaaatgttgcgcatcttggtga

SEQ ID NO: 53946 - DNA, 101 bp, rice(Oryza sativa)
  misc_feature (71): n=t or c
tcggcattgacgaggaggctcgcgacgtaagatctcgatcgattatatatatacttgatttttagttgtangtatgatgaagaacctttacgatgatctct

SEQ ID NO: 53947 - DNA, 101 bp, rice(Oryza sativa)
  misc_feature (71): n=a or c
ataaagttgtgaagctgtttaaaccatctcagctctttatttcatttcgtatctagttctggtaaaggcanttcatcaatctcctttctttttctttttct

SEQ ID NO: 53948 - DNA, 101 bp, rice(Oryza sativa)
  misc_feature (71): n=t or c
caaaatttgcatttcagctgtttgtatatacactcgtttactgtagtatatggtattggcacatatacctnattaattgcccaggggtgtttaagtctaat

SEQ ID NO: 53949 - DNA, 101 bp, rice(Oryza sativa)
  misc_feature (71): n=t or g
caaacattgctagacagtgcgaagtttttatcagcataatagaaaaaaatgcaaaagactaaagccctganaactataatcaagaaaaaacattaaaataa

SEQ ID NO: 53950 - DNA, 101 bp, rice(Oryza sativa)
  misc_feature (71): n=a or g
tccatgtgttcttgatgaaaacagtgtgttccatgtgtgtccttttttttggatttttttttgttggaggngattctgactgggatttttctggggtgggg

SEQ ID NO: 53951 - DNA, 101 bp, rice(Oryza sativa)
  misc_feature (71): n=t or c
ttcctagagtcgctccccctcctccactctctcttgagctctccgcctccacctcggattgggatagcaanagtaactttgtgatattctcagccgtccga

SEQ ID NO: 53952 - DNA, 101 bp, rice(Oryza sativa)
  misc_feature (71): n=t or c
acggtggcggggtgaccgacagcgattgcggcggatgaggacgaggtgcagccaatgaggttgtacgacgnaagctaccgggaagctgtgcgaccaccacg

SEQ ID NO: 53953 - DNA, 101 bp, rice(Oryza sativa)
  misc_feature (71): n=t or c
aacacatcccgccaccatctatgtcgctgctcgagctgtcgtctccaccactacgtctcttcttcagcaantccagccgacgcctatgagtttatcgccac

SEQ ID NO: 53954 - DNA, 101 bp, rice(Oryza sativa)
  misc_feature (71): n=a or g
agtcataagatcatccttgatgatctcccaaaaaacttgatagaactctgcaggaaaaccatctggacccngggccgaattatgttccatttcaaaaactg

SEQ ID NO: 53955 - DNA, 101 bp, rice(Oryza sativa)
  misc_feature (71): n=a or g
ttaagaggagataaagattatgtttattttattttttcatgtgactgacatgtcggccccactaacatttnaatcagggttaattggatccatgccattat

SEQ ID NO: 53956 - DNA, 101 bp, rice(Oryza sativa)
  misc_feature (71): n=a or g
tgtcattacttcatttccctctaagacaatatgcaggatgaacacacatgctcatagattcacaaccgaantctattgtcatagaattaatatgtcgagga

SEQ ID NO: 53957 - DNA, 101 bp, rice(Oryza sativa)
  misc_feature (71): n=t or g
gtgagttgcagtattaggccaactgtatgagatggatctgttaccgttttcgggccctggcttgtcgtaanggttattagcaaagtcttctcttatcaatc

SEQ ID NO: 53958 - DNA, 101 bp, rice(Oryza sativa)
  misc_feature (71): n=a or g
cttaaaaagaatctataacaagtggtctactccctccataaaaaaaacacttaacttgtgaccccttctanaacaacaaatctggacaaaggacccctcct

SEQ ID NO: 53959 - DNA, 101 bp, rice(Oryza sativa)
  misc_feature (71): n=a or g
gagttgaaaaagaagggaacttatacactaagacgattggatttaaattagatggaaggttgagaattaanctgatcctaaacgattttgttatacatttg

SEQ ID NO: 53960 - DNA, 101 bp, rice(Oryza sativa)
  misc_feature (71): n=a or c
cattttaaacactaaataattcttaatttccatgtttccaaaataaaaattatttggtggatacagttttnttgcaactctagatattgtgctcgatggct

SEQ ID NO: 53961 - DNA, 101 bp, rice(Oryza sativa)
  misc_feature (71): n=t or c
catcatttgtccaattgaactggccttgatccttataaagggcttggtcttgcctcttactggacctcctncatatcaaactcagggtagagaccaattag

SEQ ID NO: 53962 - DNA, 101 bp, rice(Oryza sativa)
  misc_feature (71): n=t or c
atcatggatggagattgttcgtgttgatctatgatggatgggggaataaaaattgaatcaatatggatttnttgatctatgttgcagatagggattagagg

SEQ ID NO: 53963 - DNA, 101 bp, rice(Oryza sativa)
  misc_feature (71): n=t or c
taggcaatttatatgccataccgttatccattctgagcatggactaaatatttagaacgtaaattttgaanagactaaccttttagtgtgccggaactatt

SEQ ID NO: 53964 - DNA, 101 bp, rice(Oryza sativa)
  misc_feature (71): n=a or g
caagtcctcgggagaggtccttgccatggagtaagtggcaccttccaggcgctccaacccccagagcgacnactcgcgcaaggcatggtgcccaatccaca

SEQ ID NO: 53965 - DNA, 101 bp, rice(Oryza sativa)
  misc_feature (71): n=t or g
atccatccatcaccgatggcgggaagcgacatggacgacctcgtcgcgcggttcatggacatcaccatgcncgacagtcgagacgccgcagctaaccacat

SEQ ID NO: 53966 - DNA, 101 bp, rice(Oryza sativa)
  misc_feature (71): n=t or c
catgtttattacaatcaagacgaaggcagtttaaattagactattcatgtccccatctctttccgccatcngttgtcccatgttttacaaccatgctaagc

SEQ ID NO: 53967 - DNA, 101 bp, rice(Oryza sativa)
  misc_feature (71): n=a or g
agtcggcaccgtgctgggtaattaaccttctcttgaaaggcgccgccctgtatgggtaaacaattcgatgnttcacaaagttattttgggagacggctttg

SEQ ID NO: 53968 - DNA, 101 bp, rice(Oryza sativa)
  misc_feature (71): n=a or g
gtcatctacgcgggcatgagccacgcctgaggtcggcggccggcggacgtcgaaagaaacaaattaaagcntcgacacaaaagcacgaatcccaaggttca

SEQ ID NO: 53969 - DNA, 101 bp, rice(Oryza sativa)
  misc_feature (71): n=t or c
gatgaggctgttcagcacggccatcttgcccgccccttgcacgagcagatcagaactggatcagatcgggngagcacacgagagagcgagcgggcagatcg

SEQ ID NO: 53970 - DNA, 101 bp, rice(Oryza sativa)
  misc_feature (71): n=a or g
tgcatcaacccactgtacgacgaataatcttcatcagacttctgaagcagcatcgcgtaacaaaaaaaacntaaatattaggaaatgacataatatcaaat

SEQ ID NO: 53971 - DNA, 101 bp, rice(Oryza sativa)
  misc_feature (71): n=t or c
ccccggccccacctgtcccgttgccaccctttgtcaacgtattcaaaacgacatcgaattattaacacatncttataactgtacatcggtccataaccaat

SEQ ID NO: 53972 - DNA, 101 bp, rice(Oryza sativa)
  misc_feature (71): n=t or g
actagatcaacaccgccacgtaggcgtcatgtcgatgaaaccgtcctccaaaattgccaagggagtcaaantccatcggttttagtagttgaggtggtcaa

SEQ ID NO: 53973 - DNA, 101 bp, rice(Oryza sativa)
  misc_feature (71): n=a or g
aacctgacttgtgattgacttcctgcatgtgaactgatgaacctttgtagggttcagagttgggattttcngtcgccgatcgtagtagggttggtgaatgt

SEQ ID NO: 53974 - DNA, 101 bp, rice(Oryza sativa)
  misc_feature (71): n=a or g
acatcccccctctttctctcatttctcccttcctctccccatctttttctctctcaccgcgagcaggggcngtgggccgatgaggaggcgccaggccgatc

SEQ ID NO: 53975 - DNA, 101 bp, rice(Oryza sativa)
  misc_feature (71): n=a or g
gcccagagcaagcaaccaatggcaggcgcacgcacacaccaaatgaggctaccatcaaatggcctaatcantcaaagaaaaagtcaaattttaaattttcc

SEQ ID NO: 53976 - DNA, 101 bp, rice(Oryza sativa)
  misc_feature (71): n=a or g
gcttttctaatgatatttctcacatggtattccattatctgaggccttggttgtagattttgtgacctagnaattggtggttgcagcgcaatatgattata

SEQ ID NO: 53977 - DNA, 101 bp, rice(Oryza sativa)
  misc_feature (71): n=a or g
ttaattgccgtacgttgattcatacattatcgattatacttctatccttgaaaccctaccgcatccaacgnatttgtatgccaagcgtcacttctagaacc

SEQ ID NO: 53978 - DNA, 101 bp, rice(Oryza sativa)
  misc_feature (71): n=a or g
tatagcccagtaggattgagcaaaagggcattggaagaataaatgcaacagatcttctagaatatgagcanaacaaagaacacaattaagattggaattgg

SEQ ID NO: 53979 - DNA, 101 bp, rice(Oryza sativa)
  misc_feature (71): n=t or c
gtacatacgaacattgacttgactcttgtaatgttggcttgtttcgaagtgcacgatcgaaacaaaccaanattgttgaggtattatacggttgaggattg

SEQ ID NO: 53980 - DNA, 101 bp, rice(Oryza sativa)
  misc_feature (71): n=a or g
gcttgtcggccaacacctccatgcccatccggtgaagcaggagccaaacgacggtgaggaactcctggccnctgacacccaagctcttcaagtgtagagac

SEQ ID NO: 53981 - DNA, 101 bp, rice(Oryza sativa)
  misc_feature (71): n=a or g
gtccacctccggccgcttccctttcacctccttcacggccactgccagccagaaacagctcatccatcccnagctactagctgctcaccatagccacagcc

SEQ ID NO: 53982 - DNA, 101 bp, rice(Oryza sativa)
  misc_feature (71): n=t or g
tcgtagttttaggcgtgggacaccacccgaactcacttttgggtgaaatactccataaacgtggtaatttnccaatggacaccgcgccgattaaaataata

SEQ ID NO: 53983 - DNA, 101 bp, rice(Oryza sativa)
  misc_feature (71): n=a or c
tcatgcacggcctcaaccatcctgtttgccacttagcttaaatgccgataaaattgtattgcagagaatcnatctcaggaacgaagcgaaaactgcaactc

SEQ ID NO: 53984 - DNA, 101 bp, rice(Oryza sativa)
  misc_feature (71): n=a or g
accatcttcacatgcagctgagagtacacgataaacaacatcacgtgccctccttgcacctgtaaatcaanctccatagttttgcacatttttttaagagc

SEQ ID NO: 53985 - DNA, 101 bp, rice(Oryza sativa)
  misc_feature (71): n=a or g
taatcggatgggtagaactaatagagagaagacattcaacactggaaggattggataaatccactgaatcntaacaggggtaaatagcttaattaaaaatt

SEQ ID NO: 53986 - DNA, 101 bp, rice(Oryza sativa)
  misc_feature (71): n=a or g
acattgatcatccatgtatttatgcatatgaattactcatttgcatgatccttttttaaccaatttcatcntttacacatgtgcatatgtagattacaaga

SEQ ID NO: 53987 - DNA, 101 bp, rice(Oryza sativa)
  misc_feature (71): n=t or g
cctctcttacaaaaggagataaagatatagctagtacactccaatcttgcaaaaccaacatatagagaganatatatatatgtaatcatttaggccctaaa

SEQ ID NO: 53988 - DNA, 101 bp, rice(Oryza sativa)
  misc_feature (71): n=a or g
ataatcatctgcccttttattgcgacaaataatttacaacgttcgtgcaaaaacactactccagttgatangcttttgaattggcagaattccagtaatca

SEQ ID NO: 53989 - DNA, 101 bp, rice(Oryza sativa)
  misc_feature (71): n=a or c
atggtagttatttctttatgttattttacctatgcattgtaaaccgaaagtaaaaaagcacataatgcttntaaaaaattaaacacacaacaaattttcaa

SEQ ID NO: 53990 - DNA, 101 bp, rice(Oryza sativa)
  misc_feature (71): n=t or c
ttcttcccgtcgccgatcccttcccctcctcccgatccccctcttttttcatttttcttcccgtcgccgcngcctcctgatcccttctcccgatccctctt

SEQ ID NO: 53991 - DNA, 101 bp, rice(Oryza sativa)
  misc_feature (71): n=t or c
tttaaaatgatcaaagagaggaaaactttttttcatttgttttctgaattcacatgtgtgtgtgtgcgcgngcgcgcaggtgaggctttgtgctcgctgtc

SEQ ID NO: 53992 - DNA, 101 bp, rice(Oryza sativa)
  misc_feature (71): n=a or g
gagataccctcccggtaaaaaatatttatcatttaattaggacaagattgtgtggcatatattaagagatncccaccccggtaaaaaatatttatcattta

SEQ ID NO: 53993 - DNA, 101 bp, rice(Oryza sativa)
  misc_feature (71): n=t or c
gcttaatgattccagcgcatcacacacatcgcagggctgtgcacatgggtgtgcaacccatgcgaccatanagggtctccaaatttccaggcctcaaaaaa

SEQ ID NO: 53994 - DNA, 101 bp, rice(Oryza sativa)
  misc_feature (71): n=a or g
ccatgtggtccaccttctccccttcagcctatataaagggaacccccatgacctcctcctcccattccccntgctgcttgagcgccatgctcgctctatcg

SEQ ID NO: 53995 - DNA, 101 bp, rice(Oryza sativa)
  misc_feature (71): n=a or g
gttcaggaacatcaaatatctccataataaacggaaaatattaatccaaccaggacaaacaatattcaganttttttttttctaaaaaaacagatggccct

SEQ ID NO: 53996 - DNA, 101 bp, rice(Oryza sativa)
  misc_feature (71): n=a or g
gcatggccccttcaccctccaggaccatcgggcatcggcaccgaaataattttggatggtctcatcacttngtggtgatgcactctttcaaaataaaacaa

SEQ ID NO: 53997 - DNA, 101 bp, rice(Oryza sativa)
  misc_feature (71): n=a or c
ggaaatgaggggcctcagcagctgccggcgatggccggaggaacagagaggaaaagagaaaggaggaaganagcaaggaagaagaaacgggtggttgcagg

SEQ ID NO: 53998 - DNA, 101 bp, rice(Oryza sativa)
  misc_feature (71): n=a or g
tcaaacccttcagatcaacttccttctgacagcttgtcttcattttggcttcccacgatccaaactccttntagttactgaaggcaactaccttgaatata

SEQ ID NO: 53999 - DNA, 101 bp, rice(Oryza sativa)
  misc_feature (71): n=a or g
gggcggccggatccagcccggggcagctccccttctccactatctccagcataactccccttctctgaccnccgcagcagctctccctcctctccgccgct

SEQ ID NO: 54000 - DNA, 101 bp, rice(Oryza sativa)
  misc_feature (71): n=t or c
ttatgtgcactttgatatagaagaccaaacatatacttcctcatctccgaattactgaattaacttggatngagccacgtcattaaagaaaaaaaaggttt

SEQ ID NO: 54001 - DNA, 101 bp, rice(Oryza sativa)
  misc_feature (71): n=a or g
gtttattacaggtggtgcatgcgtagcatgattctatttttgggaaaagaaaaatgttgtggtaagtggcngcactatctttttgcaacgttgcggtggct

SEQ ID NO: 54002 - DNA, 101 bp, rice(Oryza sativa)
  misc_feature (71): n=t or c
ttgattacccgttatttgtcggtatgcaatggtcatgcacctgttttttcctttttacaaaatttatttcnaatttttccttattttttccaccattttct

SEQ ID NO: 54003 - DNA, 101 bp, rice(Oryza sativa)
  misc_feature (71): n=a or g
gttgcacaaagtaaagagaccagggagtgcttcaattgtggtgaaatggggcaccttatacgtgattgccncgctcctcgcaagcctagttatgggagagg

SEQ ID NO: 54004 - DNA, 101 bp, rice(Oryza sativa)
  misc_feature (71): n=t or c
tgcatgcctcatcacttaaaaactaattatgtgtcaggacaggtgaatccacaaagacactgacaccaatncggagacaaccaaccgcattggccgggggc

SEQ ID NO: 54005 - DNA, 101 bp, rice(Oryza sativa)
  misc_feature (71): n=t or c
tagtatactgtacaacaagcgcacgctctccctcatgaatatacacacgcattatatatatactctgctcntaaaaacataaattagatcggtatatctta

SEQ ID NO: 54006 - DNA, 101 bp, rice(Oryza sativa)
  misc_feature (71): n=a or g
acacaacatttacgatgggtgttgcctgcttgatgtccagcacacgcagtctttccctggaaatggtgctnacgtgattcccaccaagtgttcgacgttgg

SEQ ID NO: 54007 - DNA, 101 bp, rice(Oryza sativa)
  misc_feature (71): n=a or g
caaggacacaaagattaaccatgttaatggagcaaacaaagatggtgagtcataccagctgatccaggtcnggattgctcaagggtacaaacaatatggtc

SEQ ID NO: 54008 - DNA, 101 bp, rice(Oryza sativa)
  misc_feature (71): n=a or g
tgccactgcagcgcctgtcgccaccactccgccgtcgccacggcctaacaacttgtttggtaactcgaggnaaggggattgggagtttacacgagggaatt

SEQ ID NO: 54009 - DNA, 101 bp, rice(Oryza sativa)
  misc_feature (71): n=a or g
ggtcttgcgaaatcatcgtttccagaacatattataagcaaaacaagatatacattacctagaaaaagaantaataatttatatatataaacaaaacatgt

SEQ ID NO: 54010 - DNA, 101 bp, rice(Oryza sativa)
  misc_feature (71): n=a or g
ccaggcgtgctttgtacttggtgatgttgccggcggcgtccttcttggccttgtagacccacttgagtccnatcggacgttggcgcgctagcggatcaacg

SEQ ID NO: 54011 - DNA, 101 bp, rice(Oryza sativa)
  misc_feature (71): n=t or c
tgcaagatcatcggagaacgaaggaaccttcacatagcggtagatcaaccagttagcaaatttatagctcncctggcacttctatgctttgtgagatagca

SEQ ID NO: 54012 - DNA, 101 bp, rice(Oryza sativa)
  misc_feature (71): n=a or c
ctttccttcttcatcctccatctctctccctttctcctcaccttgatccattcgcggatagcgaggagcgnaggctggagcggtgatagcgggcggagggg

SEQ ID NO: 54013 - DNA, 101 bp, rice(Oryza sativa)
  misc_feature (71): n=t or c
atcctctcttgctattatatttaaaactttggcgctgacctctcttcaatctacaaatattactaagctanaagctaccattgcaaataaaaacgagatag

SEQ ID NO: 54014 - DNA, 101 bp, rice(Oryza sativa)
  misc_feature (71): n=t or c
accggagtggagaaagcaatgccaggcagaaagactgccggtccaacaagagaagaaacaagagaaaaccngcctagtgaagtagagctcgccgagatggt

SEQ ID NO: 54015 - DNA, 101 bp, rice(Oryza sativa)
  misc_feature (71): n=t or c
agacggcagcaggccggcccaacataaagcaaacgcggcccagcagccagcccacagaacagagaagcagnagcccagtacagcatagttatgtgtgatac

SEQ ID NO: 54016 - DNA, 101 bp, rice(Oryza sativa)
  misc_feature (71): n=t or c
cattatgtacttaaaagttaaccaaattgaaacctgaatagataatagaaagttaggcatcatataagcangaaataatcaatattaataattactcatca

SEQ ID NO: 54017 - DNA, 101 bp, rice(Oryza sativa)
  misc_feature (71): n=a or g
aggggtcaaggtgggttttgcggtccaagatgggattttgtctggctgttcctcgggaacgacaaagatcngatctgaatcctctatctgaaggtagaacc

SEQ ID NO: 54018 - DNA, 101 bp, rice(Oryza sativa)
  misc_feature (71): n=a or g
ataaaatgaaataaaaatggatatcgtttttaaccattttcatctctacttggcacgagtacaagacgatnaggccgacctatatataagatcgacggcta

SEQ ID NO: 54019 - DNA, 101 bp, rice(Oryza sativa)
  misc_feature (71): n=t or c
tgcgcacgcacgctgccgcaccatcgtgcttctcagccgctccgagtcccccatccatcatgcatgtacanggcgggcccatctccccctagtcgctctat

SEQ ID NO: 54020 - DNA, 101 bp, rice(Oryza sativa)
  misc_feature (71): n=a or c
gtgtaaccttgccataacccaccttaggtatgtacggcaatatgttgtagcatggagcaaaagcatagtcntgaaattgtgaataacaagtacaagtgtga

SEQ ID NO: 54021 - DNA, 101 bp, rice(Oryza sativa)
  misc_feature (71): n=t or c
ttcttcacatcaagctggtggacaggccatccgtgaaagactgctaggttgagtacagtgcggacggtggngggcctgacgaccgcactgaacgtctcgtc

SEQ ID NO: 54022 - DNA, 101 bp, rice(Oryza sativa)
  misc_feature (71): n=a or g
ttaattaggaatgcatggctgcaatctcacgtaataaataagttatcggcgacataagggcacccataatngttatgtcacactccaatccggcaccgccg

SEQ ID NO: 54023 - DNA, 101 bp, rice(Oryza sativa)
  misc_feature (71): n=a or c
cctcctccagcgccatcacgatctccaccgtgtccagcgagtccgctcccagctccgtgaactgcgactcnggcgccagcttcgcctcctcccccagcgcc

SEQ ID NO: 54024 - DNA, 101 bp, rice(Oryza sativa)
  misc_feature (71): n=a or g
ctcattaagggcgtcatctcgccgaagtcgtgaaggctgtcttatccccgaaacaaactgccccagccctntcgatgctgccaccttgccctttggcctct

SEQ ID NO: 54025 - DNA, 101 bp, rice(Oryza sativa)
  misc_feature (71): n=a or c
tagcatccctgaactggattgcgaagaatatatgtggcttccatttggttatgtatggataaatgcgcttncgaagcagcaaacatccagtgtctcttaga

SEQ ID NO: 54026 - DNA, 101 bp, rice(Oryza sativa)
  misc_feature (71): n=t or c
cgcataccgctccttaaaagacccacatgtgaaaagtccagtcgaccttcctccaccttaaaaatctaccngctcattttttatccactcctacctcattc

SEQ ID NO: 54027 - DNA, 101 bp, rice(Oryza sativa)
  misc_feature (71): n=a or g
acagcgtcgtcttcgaccctttgtcaccgcccatcttgtagatctcctcaccagctccttcctggtcacgncttacctatttgtgcggctagcggtgggca

SEQ ID NO: 54028 - DNA, 101 bp, rice(Oryza sativa)
  misc_feature (71): n=a or g
tcctaaatccatgaagtaatgcttcatactcagctacattatgggacgctgaaaaatgaatccacaacacntagctaagctgctctccagtcggggaaatt

SEQ ID NO: 54029 - DNA, 101 bp, rice(Oryza sativa)
  misc_feature (71): n=t or g
ttgcaaatgactttgccagagatggccatatgtctgctaacgagatttctgaatttgttagagatgtactnctatccaaatgtatactgcctattaaatac

SEQ ID NO: 54030 - DNA, 101 bp, rice(Oryza sativa)
  misc_feature (71): n=a or g
gatgaagcttttcgcattatagtagagggctgggaacagcatgtcagtgatgctagattgctccttgaacnccaggttatgaagcatctatagtaacttct

SEQ ID NO: 54031 - DNA, 101 bp, rice(Oryza sativa)
  misc_feature (71): n=a or g
cgacgaaggaggctgacgaccgcgcaggccaagaaaacggggctgacggagggtctccgagaagaaaggtngctgcaatccggacggacggagaaggcagc

SEQ ID NO: 54032 - DNA, 101 bp, rice(Oryza sativa)
  misc_feature (71): n=a or c
ctcttcaaaaatatctgactccgatacgccaaaaagaaaaaaaatatttttgataccttacatctcaaccnttcctttgacaaggcaattttaccacttga

SEQ ID NO: 54033 - DNA, 101 bp, rice(Oryza sativa)
  misc_feature (71): n=a or g
tttttgggccacctgaggatacttccatcacactagatgaatatagaattgaggatattctgcaggtaacnaatgaggaaaatgaattcctaacggcacct

SEQ ID NO: 54034 - DNA, 101 bp, rice(Oryza sativa)
  misc_feature (71): n=a or g
attgtagtggataaatgtgcgcatgaggatactcaaaatgctagcatgacaatcaagaatactcgagttcntgcatcacacaatttttcacaagaaaagtt

SEQ ID NO: 54035 - DNA, 101 bp, rice(Oryza sativa)
  misc_feature (71): n=a or g
gaacatagaatcaggtgtaatgggtctgttcggccggtatttttcacagctgcacggctggctagctgcantagcgagctgcaagccgcataatacaaacg

SEQ ID NO: 54036 - DNA, 101 bp, rice(Oryza sativa)
  misc_feature (71): n=a or c
ttgatggaaagttctcggagtcctctttccaacagatctggctttatcagcagactccatcttgtttggcngcaaatacaaaaacaagttgttgcgtcacc

SEQ ID NO: 54037 - DNA, 101 bp, rice(Oryza sativa)
  misc_feature (71): n=t or c
gagcagcttaaaattatcccgaactgattcagaacagtataaaaaactgttgtgatcgcaagggatttccnggagcgcaggtgaggcgactgctcaccgcg

SEQ ID NO: 54038 - DNA, 101 bp, rice(Oryza sativa)
  misc_feature (71): n=a or c
atgaagcgaggaggctactaggaataggatggagggagacacaacacgggcagacggcaggccagcgaggnggagacggcgaccgctgctgccgatgaccg

SEQ ID NO: 54039 - DNA, 101 bp, rice(Oryza sativa)
  misc_feature (71): n=t or c
catagtttatttattgtcatcacatacatgtcccatgagttgttttctccatttgtagaatatgacacatnttaatattatgaatcggggtagatctcctg

SEQ ID NO: 54040 - DNA, 101 bp, rice(Oryza sativa)
  misc_feature (71): n=t or c
tctaaattccttcacataacttattgagtgaaagtgttgaacaatgtaacaattaattttcttaaaaatancattcataacatcataaagtttagcctaat

SEQ ID NO: 54041 - DNA, 101 bp, rice(Oryza sativa)
  misc_feature (71): n=t or g
cattgttgttctttagtttatgcaagtacgtacaactgcactttgcatcttttttgcagtgcagtaggcanctggaagccatgaccactatatttaatctc

SEQ ID NO: 54042 - DNA, 101 bp, rice(Oryza sativa)
  misc_feature (71): n=a or g
aggattttagcctttccataataatattttactaacaaatgtaatttactacatgttactcggaatgaggnaaagtcacttcatgttaatatcatgtgttt

SEQ ID NO: 54043 - DNA, 101 bp, rice(Oryza sativa)
  misc_feature (71): n=t or c
gtgggactaactaatctatataggtggcatcctagcgtacaaaaacagtgtagaaaaccacttaagggggncttttgcacggtattgaaagtttgaggggg

SEQ ID NO: 54044 - DNA, 101 bp, rice(Oryza sativa)
  misc_feature (71): n=a or g
ctgcaatcaaatattctcagttggcgaacgcctgaacgggatatgctgatgcaaaagatatatattctccnaactcagatcatcttatggaaaaaaagaac

SEQ ID NO: 54045 - DNA, 101 bp, rice(Oryza sativa)
  misc_feature (71): n=t or c
tccgtaccgttttcacccctagcgagcacaggtcgtgcgcccaagcactatactaatagtactggtactangcagccatggtaggatgtagtactgtatag

SEQ ID NO: 54046 - DNA, 101 bp, rice(Oryza sativa)
  misc_feature (71): n=t or c
ctacttcctgtcatttaacctcagttgatgctactgctggagttacagcaaaagttgatgacactgctgcngcagatccacttgactcagagacacaatct

SEQ ID NO: 54047 - DNA, 101 bp, rice(Oryza sativa)
  misc_feature (71): n=t or c
taattcggctttaattcacatatttaatcttttaaaggttgtgaatgatggcaggccggtgatcttccccnagccattattaccccgagttttgtggattc

SEQ ID NO: 54048 - DNA, 101 bp, rice(Oryza sativa)
  misc_feature (71): n=a or c
agaaataattaccgtatggaggaaaaaggtcatgtagcacatacaccctccgctttttaatgtatgatgcngttcacttttaaacatatgtttgatcattc

SEQ ID NO: 54049 - DNA, 101 bp, rice(Oryza sativa)
  misc_feature (71): n=a or g
atgcatggcctggtggtgtatatgcgctgtatatgggaagctgctgttggaagttcatgattaaggaatanatcccagtgtcgtttgtgtggatctactgc

SEQ ID NO: 54050 - DNA, 101 bp, rice(Oryza sativa)
  misc_feature (71): n=a or g
ctaaataatgcagtagaaaaaagtttatagaaaaattgaagtgtgcagcgaataatttatttcataatccngtaaataattttaaaagaatagggagttgt

SEQ ID NO: 54051 - DNA, 101 bp, rice(Oryza sativa)
  misc_feature (71): n=a or g
gctgcacttattttgggacggagataatatttatatcgaactttttaaaaaaatccactcccgactagaantcctgtccaaagaaggccttttaagaagag

SEQ ID NO: 54052 - DNA, 101 bp, rice(Oryza sativa)
  misc_feature (71): n=t or c
ggccgggggtaatcatcgcggggaaagcgacgcgatcctcgtctgcgcatggacacagatagtgaccggcnccagcttagagcaagtttaatattatatta

SEQ ID NO: 54053 - DNA, 101 bp, rice(Oryza sativa)
  misc_feature (71): n=t or c
gcatccccaaattcaaaaggaaagttatgtgggggccagttgcaggcttccagccagcaaacagaaggtgnacatcatgacagaagtattaggccctattt

SEQ ID NO: 54054 - DNA, 101 bp, rice(Oryza sativa)
  misc_feature (71): n=a or g
ttatgtatagttaattgaagaacaggagatgaagcaagcaatgcgtgcgatgagtttcagagcaggcgaanagccatttctagctagctgtgcccgtttgc

SEQ ID NO: 54055 - DNA, 101 bp, rice(Oryza sativa)
  misc_feature (71): n=t or c
gtgatgacagccatttcgtcactgcaggcagacagtgacaggaaataagctgttatcgtcgtaatgtaatngtcatagaagcccagaattcctgtagtgta

SEQ ID NO: 54056 - DNA, 101 bp, rice(Oryza sativa)
  misc_feature (71): n=t or g
gatgttttgctttcccggtacagcaatggccatcttatcgtcagaagggtcactgacatagaaaacttgancaacacgctcagcaagaacccacggatcat

SEQ ID NO: 54057 - DNA, 101 bp, rice(Oryza sativa)
  misc_feature (71): n=t or c
gatggagatagatcgatttaaagttgtgatgtgggatttgatttttgaccaacggtgaagattatcctatngatttgatcgaaggtcatatttttctagtt

SEQ ID NO: 54058 - DNA, 101 bp, rice(Oryza sativa)
  misc_feature (71): n=t or c
aaatatgttgtgccttatattatgagatggagtttttttaagtagcatacattataactaaaagttgatanatatctggtgagtcttgaattttatataga

SEQ ID NO: 54059 - DNA, 101 bp, rice(Oryza sativa)
  misc_feature (71): n=a or c
ttgtctgtcgattggcaggtatcaattcacctactggaatacctgcatgttgcaatgggaatttccagtgnttctttggagattgggagtgggagaaaaat

SEQ ID NO: 54060 - DNA, 101 bp, rice(Oryza sativa)
  misc_feature (71): n=t or g
gctgtacctgccaccactagtccgtctgctgttggggtctcttcttgccagctccatctcgctactagcgntgtggtggtggtatggtggccttgtgctcc

SEQ ID NO: 54061 - DNA, 101 bp, rice(Oryza sativa)
  misc_feature (71): n=a or g
cttcatgttcagcttatgcactaaatcattttttgttgagagaatggcccgtgtgctcatatattccacgnaggtcgtatttctctcatcattgagcgagg

SEQ ID NO: 54062 - DNA, 101 bp, rice(Oryza sativa)
  misc_feature (71): n=a or g
tttggtgttggacttcataatttgggtaaaattttaaaattgagcacagctacgagcatactaagggtgtnttcggacctctaggttcccaacccaaatct

SEQ ID NO: 54063 - DNA, 101 bp, rice(Oryza sativa)
  misc_feature (71): n=a or g
cgccagcatcgccgtcgtcatcgacccggcccagccactcccagccactccactccaaggaatggaggcanagctcctcctccttctgcctcatcgccctc

SEQ ID NO: 54064 - DNA, 101 bp, rice(Oryza sativa)
  misc_feature (71): n=t or c
gtcacctgatgaattaattgagatggcgcacaaatattatgatgatacagctctgccaaaattggtaatgnattgtactcatgtggcatcaatctcaaaca

SEQ ID NO: 54065 - DNA, 101 bp, rice(Oryza sativa)
  misc_feature (71): n=t or g
ccctcaacttattatctgatgataaagatgtttgggcttatgtctaggggaatggactgttctcttctcanaaaatttatacaataaattgcatgcatgtt

SEQ ID NO: 54066 - DNA, 101 bp, rice(Oryza sativa)
  misc_feature (71): n=t or c
gatagatgaccaatgttgttaatttttttaaaaactatttgactattagtatctgagactcaccaacaaangaagtgaacacatgtattgacatctttagc

SEQ ID NO: 54067 - DNA, 101 bp, rice(Oryza sativa)
  misc_feature (71): n=a or g
gaagcaaacgattggaggagttggaccagttggatgggtggatggtgatggagaagaagaggagaggagangagaaggtgaggaggtgcaagaagaggaga

SEQ ID NO: 54068 - DNA, 101 bp, rice(Oryza sativa)
  misc_feature (71): n=t or c
acacacacagaaaggaaatgtccatacgtactaaaatttccttacaaaatacttatagactatgatgtgangagctctaagtaaatctagatctcttgtaa

SEQ ID NO: 54069 - DNA, 101 bp, rice(Oryza sativa)
  misc_feature (71): n=t or g
ggaggaggaggaggaagagaagagaagggagaggagaagggatggaggaggataaggatggagaagggatngagaaggatggagaagggattaatgagagg

SEQ ID NO: 54070 - DNA, 101 bp, rice(Oryza sativa)
  misc_feature (71): n=a or g
tagcactgtagcacgggtactgttcacatggccactgtagctttacatctaaaccgttgatcagaaaaacngatggctggtgttgtgtgcagtgttaactt

SEQ ID NO: 54071 - DNA, 101 bp, rice(Oryza sativa)
  misc_feature (71): n=t or c
ctgtaattgtatataacttcactttcattcaaatcttgagaaaaaaatagagcaaatcatcattgcctttnaatatcccatttagagtaatattaagtaca

SEQ ID NO: 54072 - DNA, 101 bp, rice(Oryza sativa)
  misc_feature (71): n=t or c
tagttgtaacaaaaaaacgcaacatgcaatgaactatattatctagaaaaaataatatcctttagatgccntttctatatgtttgagttataattttctat

SEQ ID NO: 54073 - DNA, 101 bp, rice(Oryza sativa)
  misc_feature (71): n=t or c
cagagaagggagagagcgaggaggaagaaggatcgaggagaggatgacaagggggccacatgccagtgggncccacattttttcttttttaatgacaaata

SEQ ID NO: 54074 - DNA, 101 bp, rice(Oryza sativa)
  misc_feature (71): n=a or g
aattagcgatcgaatgttatcacactgaaagtcaatttttttttattttaaactaaaaaaatgcccgtgcnttgcaacgaatgaaggcaatctttctatca

SEQ ID NO: 54075 - DNA, 101 bp, rice(Oryza sativa)
  misc_feature (71): n=a or g
tgctagttgatcgtaattggatgtacaagggccatcgaaaccgcggcgaggttactgctgaatggattttnaagactacagaatttcttgacatggcattc

SEQ ID NO: 54076 - DNA, 101 bp, rice(Oryza sativa)
  misc_feature (71): n=t or c
agagaaaatatacatgaagtatggaaatataacttccatatccaagtccatggagtcttgagcccacaaanccaataagatcataattaaatgggccaaat

SEQ ID NO: 54077 - DNA, 101 bp, rice(Oryza sativa)
  misc_feature (71): n=t or c
cacctacgccggttggggacaatggcgatagaggggaaggctcgccagaggggaggtggttgccgatgtcnggatgggggcgggatctcgatccggaggtg

SEQ ID NO: 54078 - DNA, 101 bp, rice(Oryza sativa)
  misc_feature (71): n=t or c
accatcaaatcgcataagctatgtcaaaggatgaggccattccttgaaagcatgcatcgaaacatgccctngatgacagcgcttattgtaaacaatagtct

SEQ ID NO: 54079 - DNA, 101 bp, rice(Oryza sativa)
  misc_feature (71): n=a or g
actatgtggaggagaaataggagccggtttaggaaccggtacgtttgaggttccacgaataaaaaaaatcntctcgattcaaaccgatgcatcaatccgct

SEQ ID NO: 54080 - DNA, 101 bp, rice(Oryza sativa)
  misc_feature (71): n=a or g
ggatccgcaactgcaggagcagcaaaagaggtgtaaaaacggtactatctccattccatcccagagtgtantaaccattctagaatttgctacattctaga

SEQ ID NO: 54081 - DNA, 101 bp, rice(Oryza sativa)
  misc_feature (71): n=t or g
ttttaaaatcgatttttcttcaaattagtattggaaaccattactagaaaaagcattttttagacatgggntttttttttcaggtggacatgacccttgga

SEQ ID NO: 54082 - DNA, 101 bp, rice(Oryza sativa)
  misc_feature (71): n=t or c
cagaagacacttgcaatataagctagcccatgatgtgctcatgagcatcggtcaatctagtcggcatccgncaatgatacaggtggatgtgaaaaatgaaa

SEQ ID NO: 54083 - DNA, 101 bp, rice(Oryza sativa)
  misc_feature (71): n=a or g
atccatttgcatgttgtactgatcaatcggttgatcaagtaatgtaatgtaattctctctgacaatgttcnatgttccagtgtgcgacttctaccccggcg

SEQ ID NO: 54084 - DNA, 101 bp, rice(Oryza sativa)
  misc_feature (71): n=a or g
cgtgctacctgttatgctgtggtttctgttgtttctactgcccgaactcatgaggtatttgccatttggangttctctacactacagctatttccattgat

SEQ ID NO: 54085 - DNA, 101 bp, rice(Oryza sativa)
  misc_feature (71): n=t or c
tatctaaaatcattgatagttaaaattttaaaagtttgatctcatctcacatggatgtactgttataaaangataggcaaataaacgataaaaaacaatag

SEQ ID NO: 54086 - DNA, 101 bp, rice(Oryza sativa)
  misc_feature (71): n=t or c
aagattcaaaataccaatggcttgtaaggggttatctggattttcaccttcgcaatttgcagatgttctcnatctcatcatctcatatggtgtgaacgcaa

SEQ ID NO: 54087 - DNA, 101 bp, rice(Oryza sativa)
  misc_feature (71): n=a or c
ccttgtatacccactgaacaggcagggaaagttttgctcgttaactttagtgggtagggttcgggtgggcnaggaaagttttgctcgctaactttagtggg

SEQ ID NO: 54088 - DNA, 101 bp, rice(Oryza sativa)
  misc_feature (71): n=a or g
ggcatcggacttgccactgttttttgagcgaacaatcgcaaggtgctcatcgatgtaacgagcaaccaacnaagattgttgccaaacggtgaaatgtgctt

SEQ ID NO: 54089 - DNA, 101 bp, rice(Oryza sativa)
  misc_feature (71): n=a or g
aatcgttgcatattttacttcagcggatgttacttaagcgagagtaaatcaatagctagctagctcaatcntttcttcaaaccagatgtgtaatatgaaac

SEQ ID NO: 54090 - DNA, 101 bp, rice(Oryza sativa)
  misc_feature (71): n=t or c
caccaatttatgagtgcaattttattaattgtctaaggctgagtttttctccaactttcccaactcacctncctcgtttttcacatgtacacttttcaaaa

SEQ ID NO: 54091 - DNA, 101 bp, rice(Oryza sativa)
  misc_feature (71): n=t or c
ttccccctcctcaagggtgtggacaagccatactggtttgaggacaccgacgacgacggtggcgtcctttnagcctcatcccgttgccatctccaagagct

SEQ ID NO: 54092 - DNA, 101 bp, rice(Oryza sativa)
  misc_feature (71): n=t or c
aggaaacaagtaagagagatttgctcaaatccagcaaaaaatagcttaagttaccggtacttcatggcacnaaattattttcgatcgttgaatctaaccgg

SEQ ID NO: 54093 - DNA, 101 bp, rice(Oryza sativa)
  misc_feature (71): n=a or c
tatgcctgaaatgtgcttcctttcttttgctagtacttgtccaagattcaacctcaagtgtactctccttnttgaggaataaagttaatgatgtactacaa

SEQ ID NO: 54094 - DNA, 101 bp, rice(Oryza sativa)
  misc_feature (71): n=a or g
ctttccatcatttgtgcatgccaaaaaaaacaagtaacctactactccatttcaaaatatatttcaaaatntatgatatcgttgacttttctcataacctt

SEQ ID NO: 54095 - DNA, 101 bp, rice(Oryza sativa)
  misc_feature (71): n=a or c
tagatgataggtacttagattataagatctaccttaccccatattcaaccggttgtttctgcacctatatnacgagcaccagaaaaccctaataggggttg

SEQ ID NO: 54096 - DNA, 101 bp, rice(Oryza sativa)
  misc_feature (71): n=a or c
ggatagatcaggtcaaagcatcacattagcgcaaccatcctctaaaaccactaaaggagtcaaaattaaantgattttaatatttagggtcaagatatttg

SEQ ID NO: 54097 - DNA, 101 bp, rice(Oryza sativa)
  misc_feature (71): n=a or g
atgctctaatatccaatagtgttcttcacctgaaactctctcaagtcccacgtattttatttatgaaaacntattttatttatgaaaaagtacgaattacc

SEQ ID NO: 54098 - DNA, 101 bp, rice(Oryza sativa)
  misc_feature (71): n=t or c
catcccataatataagggatttggggaggatgtgacgtagattcgttgtcctaggatgtattacatttacncaaaatcccttatcttatgggacagaggaa

SEQ ID NO: 54099 - DNA, 101 bp, rice(Oryza sativa)
  misc_feature (71): n=t or c
taaaatagagggagtatgtgtttagagcaaactaagaaaggaaatgctcacttctagagtaatactttctncgtattttaatgtatgacgccgttgacttt

SEQ ID NO: 54100 - DNA, 101 bp, rice(Oryza sativa)
  misc_feature (71): n=t or c
atctttatagaattacctattctacagtaatttttaaggataggataggatatgactcgatcatttgtttnaaaagtttccatagtaattttttttataga

SEQ ID NO: 54101 - DNA, 101 bp, rice(Oryza sativa)
  misc_feature (71): n=a or g
aacaagacctaagggtgatatttctttcaatcactatataactatacatatatagtgtgcatgtgtatgtncttggactaggtccaagggtttaccacact

SEQ ID NO: 54102 - DNA, 101 bp, rice(Oryza sativa)
  misc_feature (71): n=a or g
ccaaaaatttagtaagatagattgatttgatatgttgttagtatttcttatgtcgacagataaaatccgcnagcgcatagatataccgctatagcacttca

SEQ ID NO: 54103 - DNA, 101 bp, rice(Oryza sativa)
  misc_feature (71): n=a or g
cgaggtcccctggccaccccataactacctaacctccccttgagggggcggggaaaaggtaggccgcacgnccacgtggctagatgggaaggttatttctc

SEQ ID NO: 54104 - DNA, 101 bp, rice(Oryza sativa)
  misc_feature (71): n=t or c
atcggtgcgtcatcgggggataagttggcggtggatgtcgggtgaaaacacaacccggctttggccgggcngacaacgatggcgctctggcgtcactatcc

SEQ ID NO: 54105 - DNA, 101 bp, rice(Oryza sativa)
  misc_feature (71): n=a or c
taaattaatatgtgttttatcacgtcacaaatatgtaaaacttgttttcttcttaaaaaattaacttctangaattgataaaaaaaatgggtgtgataata

SEQ ID NO: 54106 - DNA, 101 bp, rice(Oryza sativa)
  misc_feature (71): n=a or g
caataacgtcagtcagagggtgagcctacaccgcatgaaatcattttccgacccgggaagcaaaaatagcnaggttaccgagtacactcacgttgattgcg

SEQ ID NO: 54107 - DNA, 101 bp, rice(Oryza sativa)
  misc_feature (71): n=a or g
tggataatcagactaatcacacagtgaccaccgtccaccggagcacagtaccggcgacatgccggcatccnccgccatgtccccgcgcctccgtctccacc

SEQ ID NO: 54108 - DNA, 101 bp, rice(Oryza sativa)
  misc_feature (71): n=a or g
tttttctaattgtgacgaggtaaaatactttagttctttttagctcgtactctaattctatcatgattctnttatgaatttattgtaaaatttgtagtgat

SEQ ID NO: 54109 - DNA, 101 bp, rice(Oryza sativa)
  misc_feature (71): n=a or g
tatgcaaaaagaaagcgagagaaagagagagaaatggagtggtgtacttggatttctccaagcttagccanctcgcttttgtagagtttgcatatcagcat

SEQ ID NO: 54110 - DNA, 101 bp, rice(Oryza sativa)
  misc_feature (71): n=a or g
cggacggcaagagctaccacatcattgacaccagcttcacttccgaggaagtgttcgtgcccgcgccaccnccgccgctgctcgtctccaccgtgcgccgc

SEQ ID NO: 54111 - DNA, 101 bp, rice(Oryza sativa)
  misc_feature (71): n=a or c
attctgaattagtcatatttgcatattactattctagcaagagaagccatgtatgattggttgccccatgnttccagttgtcagttaattacacaagcact

SEQ ID NO: 54112 - DNA, 101 bp, rice(Oryza sativa)
  misc_feature (71): n=t or c
cctgaagaggaatcgtaaaccctgacgaggcatcggtggctcatgcgccggccaagagctcagccagtagntccccccacggccccacctctctctcgcgc

SEQ ID NO: 54113 - DNA, 101 bp, rice(Oryza sativa)
  misc_feature (71): n=a or g
tcgtcttcacctgcgtgtgaatgcaacacgtatatgatcagatcatcagtgcgtgcatcgctcgatcactngcgatgaaccatatatattactcccttcgt

SEQ ID NO: 54114 - DNA, 101 bp, rice(Oryza sativa)
  misc_feature (71): n=a or g
atgtccagatttgttacgttagaatatatcgaatgtcttttttgggatggagggattactacttttgcctntctacatcgggcttggcatgtacgctgctt

SEQ ID NO: 54115 - DNA, 101 bp, rice(Oryza sativa)
  misc_feature (71): n=t or c
ggccgtatttccagttctttatcctcaatccacgcatccgattatatgggtatggtccatgcttccagtgntttatcctcaatctacctatccacttatat

SEQ ID NO: 54116 - DNA, 101 bp, rice(Oryza sativa)
  misc_feature (71): n=a or g
gaaaaatccatgtactatactgtctcgatagatgacgaatgatggataattaatactgagttgatttttcnagaaaactaacgaaagaattagatataaaa

SEQ ID NO: 54117 - DNA, 101 bp, rice(Oryza sativa)
  misc_feature (71): n=t or c
atcgccattatctatccagttctaatttatctttgttctaagttttgatctaacatcgccgtcatctctgngtgttgccgccggaccgtcgtcaccatcat

SEQ ID NO: 54118 - DNA, 101 bp, rice(Oryza sativa)
  misc_feature (71): n=t or c
ataatctagaataaaaaatgcattgtttgggtagtttccgattcgacgagaaactaaaaactccctcaaanggaccctatatgtttgtctgacaaagcagt

SEQ ID NO: 54119 - DNA, 101 bp, rice(Oryza sativa)
  misc_feature (71): n=t or c
tgtttgaattttcaaaatattatcacaaaatcaattttgcacgtcggatgcaagcttgcaaggtagtaacntgatattagtctgccctctacggtatttct

SEQ ID NO: 54120 - DNA, 101 bp, rice(Oryza sativa)
  misc_feature (71): n=a or g
tcctagaccatctgatccacaatccgacggctgagctgtcaggtgcttctccgcaagaagaaaatagaaanagaacatttaagaaatgtcattgataaaaa

SEQ ID NO: 54121 - DNA, 101 bp, rice(Oryza sativa)
  misc_feature (71): n=t or c
tccccctcaattttttgttcctggatccgcccgtgcgagctatggctttgatggcatatgtagcgaccganagggaggtagctagcggttaaactgaacga

SEQ ID NO: 54122 - DNA, 101 bp, rice(Oryza sativa)
  misc_feature (71): n=t or c
ctgctggcggagctccttggcttctcggttccacttgaaacgctcgctgtgccgctggtggtggcgagaangttggcgatggtggtgcggagcgttgggtt

SEQ ID NO: 54123 - DNA, 101 bp, rice(Oryza sativa)
  misc_feature (71): n=a or c
atgcaacataaccaatgaggaactcaaaatccaagtgcagcatatccaaagagctacacataatatgtgcnaaaatattcaagagatgttgtaggcttaca

SEQ ID NO: 54124 - DNA, 101 bp, rice(Oryza sativa)
  misc_feature (71): n=a or g
gaaggaaagtatcgtgtgcaaaccctgttaataagactagccatcaacccatatgttacatggattattantattgatattataaatattaaagtctaatc

SEQ ID NO: 54125 - DNA, 101 bp, rice(Oryza sativa)
  misc_feature (71): n=a or g
tctgtttccgagaaaatatttctgaattcgtttctgttttcaaaatattccgatcgacagatccgttttcnaaaataggtctagaatccggaaagtttccg

SEQ ID NO: 54126 - DNA, 101 bp, rice(Oryza sativa)
  misc_feature (71): n=a or g
cggccgctgccgccgacgagtagcagagaagaggaagcctctgccgccgccgggggagatagcggatggcnccggcgaggcgacgagatgtagcagcagag

SEQ ID NO: 54127 - DNA, 101 bp, rice(Oryza sativa)
  misc_feature (71): n=a or g
tccaggacgatgctcagcactatccgacccagagccacagcactgcctcctgcaccgatgctcctagcctncggcgatactgctcgcttgaatcgatggag

SEQ ID NO: 54128 - DNA, 101 bp, rice(Oryza sativa)
  misc_feature (71): n=a or g
ttaacatcgatcatagatatcacaagtaattgaaaaaaggcggtttgaaaagtgatctctcctagcagtcnaatcaatatctaaaccctttatcttttctc

SEQ ID NO: 54129 - DNA, 101 bp, rice(Oryza sativa)
  misc_feature (71): n=a or g
gttctttcacctcggtatgccagcagtaagctgagcattttcaaacaacaggcaagtgccaggctggatantatatagctgataactgttagcacttttat

SEQ ID NO: 54130 - DNA, 101 bp, rice(Oryza sativa)
  misc_feature (71): n=t or g
aaattaccatgagagtaggtgggggtggcaaattcactaccgccaccactatacccccctccatcccacanaaaacaaatctagaacgagatgtaacatat

SEQ ID NO: 54131 - DNA, 101 bp, rice(Oryza sativa)
  misc_feature (71): n=a or g
tattccatgtaaatactagcagcgatccctgatatggcaaatctagtaagcttgcagtagggcgggcggcngcgacgcttttagcgtcgtttcttccttga

SEQ ID NO: 54132 - DNA, 101 bp, rice(Oryza sativa)
  misc_feature (71): n=t or g
gttcttagttcatatgtcctaagtatgcgtaattaaatatttattctgcccattgttttctcaacccactnatttgtaacagcagaactttactaacttgc

SEQ ID NO: 54133 - DNA, 101 bp, rice(Oryza sativa)
  misc_feature (71): n=a or g
tggccacataagcgtcgcgtcaatgccacatgggacaaaaactagtcaaaggagctacatcagccaaaacngggacaatactatcgagaggctgcgtttgt

SEQ ID NO: 54134 - DNA, 101 bp, rice(Oryza sativa)
  misc_feature (71): n=c or g
gatggtgctggtgatgatgccccgcgacctcgtcggttgtagagtggcataagaaaagagaaagtatacanagatggtacagtaaaatggggtctgttgac

SEQ ID NO: 54135 - DNA, 101 bp, rice(Oryza sativa)
  misc_feature (71): n=t or g
tgagcctaccggcgatggaccgccctccctcgagcttgcaagtgatggatcggccagccctaagctcgccngtgacgtcccccaatatctccagcgacgga

SEQ ID NO: 54136 - DNA, 101 bp, rice(Oryza sativa)
  misc_feature (71): n=a or g
gaatcatcgactcactaaatgcttctagcaactgctctggtaccagacataatctttatcgccttaaaagnattgtccatccaagtaaatacaagagctca

SEQ ID NO: 54137 - DNA, 101 bp, rice(Oryza sativa)
  misc_feature (71): n=t or g
ggctcgtatctggagaccatgccgtctattgtcagaaatgaaaataaaagttcaccgacgaataaaaaaanctctttgctgctacagctcaataacatagc

SEQ ID NO: 54138 - DNA, 101 bp, rice(Oryza sativa)
  misc_feature (71): n=t or c
tggggtgttgctgtaactcttgcctctcccattcttcgggtgaaaaccttctcctggctctcgggacgggngacggtggcatccttggtgtcgtttcctcc

SEQ ID NO: 54139 - DNA, 101 bp, rice(Oryza sativa)
  misc_feature (71): n=a or g
caaaacgagataactactatgaatcacatactatccacaaggacgagagaacaagatcataccttgctggnaaatcagcaggcaaataaaagatgtattta

SEQ ID NO: 54140 - DNA, 101 bp, rice(Oryza sativa)
  misc_feature (71): n=t or c
atctatttcgttttctctttcccgtgctttttctctctactgctaagctctagggtttggtagatctttgncgttttgcgctggaaaacggtcggttctcc

SEQ ID NO: 54141 - DNA, 101 bp, rice(Oryza sativa)
  misc_feature (71): n=a or g
acatatgtaagtggtaccgtcgggaaaaaaattaacggtccttaaaatagtatttttctactatataaagntaaattcgattacttcgtgatttttttaaa

SEQ ID NO: 54142 - DNA, 101 bp, rice(Oryza sativa)
  misc_feature (71): n=t or c
atatgtcaaaggcagaggagcatgtagcatggtggcttggatataaccgtgtcgatggaatattcaccggntacatcttttttatattaatgatcagaatt

SEQ ID NO: 54143 - DNA, 101 bp, rice(Oryza sativa)
  misc_feature (71): n=a or c
ctagtagtgttttgtgttcttgtaagagtgatctccggagatggaaagaaaatgctgtgtaaatgtgagtncgcaatattgatttgtgtatcatataattc

SEQ ID NO: 54144 - DNA, 101 bp, rice(Oryza sativa)
  misc_feature (71): n=a or c
cttggctatcaaataattagaaaaaaatatgagtctgttgagaattaaacacatattctttagactaaaancatggaccctttaaatacagtttaaatgta

SEQ ID NO: 54145 - DNA, 101 bp, rice(Oryza sativa)
  misc_feature (71): n=a or c
ttgtgaaatgggttaattggatctgtgccattatacattttctgatttagaaaaatgctactccatccatntactttagattggcatatttcaatccaacc

SEQ ID NO: 54146 - DNA, 101 bp, rice(Oryza sativa)
  misc_feature (71): n=a or c
gttcttcctcctcctcgtcggaggagaggacgatagggccgggagcggagccgttggatgagagtgagacnaccatggcgtccgagtcggcgccggcgcca

SEQ ID NO: 54147 - DNA, 101 bp, rice(Oryza sativa)
  misc_feature (71): n=t or c
gtgttgaatgaagaacgtgtgtaaccctctaggggtgctgtcgatccccttaatatagcagcagggtgacnggcggcaaggaggatgcaatatcccttaca

SEQ ID NO: 54148 - DNA, 101 bp, rice(Oryza sativa)
  misc_feature (71): n=a or g
tgtcagctgtgttgatttttccttgatcaagcaaccatccgaatattttgcattgctaattaggaatgctngttgacatgaaagaaagaaaaagaggagag

SEQ ID NO: 54149 - DNA, 101 bp, rice(Oryza sativa)
  misc_feature (71): n=t or c
tatagtgtagttacattataactactatgtaattgctatatagtatttgatatgtacctcaaatgtaactnttataaaagtgcaacggagcaactgattaa

SEQ ID NO: 54150 - DNA, 101 bp, rice(Oryza sativa)
  misc_feature (71): n=t or c
actaagcagacgatatgtagggttttatattctttgatctactcagtctatagccaatttggtctaaccanatcggctgagaccatcaacgatacgtcatc

SEQ ID NO: 54151 - DNA, 101 bp, rice(Oryza sativa)
  misc_feature (71): n=a or g
accgagagatatctgaattctgaattctgaaatgggagtgaccactgaccaccaccaccagcagcagcaanagtgaccgaatccaacgaagttgcagtgca

SEQ ID NO: 54152 - DNA, 101 bp, rice(Oryza sativa)
  misc_feature (71): n=t or c
atttctcttgactttcattgttcgaaagatgcctgggctagcgttgttgtcactcctctattccgaatacntaggccgagtttattttcaaaatatttctt

SEQ ID NO: 54153 - DNA, 101 bp, rice(Oryza sativa)
  misc_feature (71): n=a or g
ctggctggtaacgggcaatggatggacccaagcaaaatgagaggctgtttctttcgtgaagaggaaacganagaaccttattcttttttactctttccttg

SEQ ID NO: 54154 - DNA, 101 bp, rice(Oryza sativa)
  misc_feature (71): n=a or c
ccaggagcacacctatcacggtttttttttccatgtgaaaaactgtcaactggtggcagagaacaaattantagctagggttagaaatgtttggcattggt

SEQ ID NO: 54155 - DNA, 101 bp, rice(Oryza sativa)
  misc_feature (71): n=t or g
gaaggggggagaaagagagatgggagagagggaggagggccccatatgtcggtggccccacattttttttnaatgactaatgggtcccacatatatttttc

SEQ ID NO: 54156 - DNA, 101 bp, rice(Oryza sativa)
  misc_feature (71): n=t or g
ccattaattgatctgagcctaacgtgcaaccacatgatctcatggaaagaaccaggcctagtatgattccnagtcttggcactgtcggcccaggtggctag

SEQ ID NO: 54157 - DNA, 101 bp, rice(Oryza sativa)
  misc_feature (71): n=a or g
tagggacctaggaaacttaattatgttcaaaaagtatgaaagatagtcgattgaaatatagtagatagtcnattgaaatatagtagatagtcaattgaaat

SEQ ID NO: 54158 - DNA, 101 bp, rice(Oryza sativa)
  misc_feature (71): n=a or c
ttcagtgtgaggtgtggggaaaactagaataatctttcctttgaccagcaagaaaactcaagacagctatngctggcagcttatctaaatttgatcctcca

SEQ ID NO: 54159 - DNA, 101 bp, rice(Oryza sativa)
  misc_feature (71): n=t or c
ggagaagggggcggcaacggcttgcaaccgtcccatttccctaggtggccggattcgttggcaaggagggngacacacggtggtgtgacaaaacagggacg

SEQ ID NO: 54160 - DNA, 101 bp, rice(Oryza sativa)
  misc_feature (71): n=a or g
tattcagattactaccaaaatcaacctccaaaatttggcaatgctgaattttttataaatttatagaattnccaatttttgataggatggaacaaatatgt

SEQ ID NO: 54161 - DNA, 101 bp, rice(Oryza sativa)
  misc_feature (71): n=t or c
tgtaccagaaagctggtagtccaacgcctgatctggccattttctggtgctggatttttcacattttgatncttttgaaaaacttatttcgcaaatagacc

SEQ ID NO: 54162 - DNA, 101 bp, rice(Oryza sativa)
  misc_feature (71): n=t or c
tgacgctggggttgatcctgcaaaatgagtactcgtgtagatattcccaagaggatgggaacgactactgntgaaacgcatcggactgaaaaggagggaga

SEQ ID NO: 54163 - DNA, 101 bp, rice(Oryza sativa)
  misc_feature (71): n=t or g
tattttaatatatcttcctccaattgagtgagtaaacattataaaagaaaattttacccttccgtcacatnacaagattaaattttgaacaacttttctct

SEQ ID NO: 54164 - DNA, 101 bp, rice(Oryza sativa)
  misc_feature (71): n=t or c
attttttttaattctaatgccacgtaagcgccacgaggataaagactggattagcaccgccacatcagcgncacgtcagcaaaaccgccatcctaaaccgc

SEQ ID NO: 54165 - DNA, 101 bp, rice(Oryza sativa)
  misc_feature (71): n=a or g
ctcacccgacttcaagaagatggctagatccaagtcggcgacgtcctccacctcgatttgtccccttctcngagggagacgagtcttttccccgccggggt

SEQ ID NO: 54166 - DNA, 101 bp, rice(Oryza sativa)
  misc_feature (71): n=t or c
ttgtagaagctaccacctaccatccagaagttcgagagaggtacaaatactgcaaaaatgctactacctcngtttcaggttacaggactttctagcattgc

SEQ ID NO: 54167 - DNA, 101 bp, rice(Oryza sativa)
  misc_feature (71): n=a or g
agtagagtacaaaacttcacgtcaattttttgcttttttttaaaaaaacaagtcatctccaagtcgtcacntcatcaccgtaatgatcggctaaggtggtg

SEQ ID NO: 54168 - DNA, 101 bp, rice(Oryza sativa)
  misc_feature (71): n=t or g
tactggcttgtgttgttgcggagcggcgtggaattcgtgggccgttgctttggtgggctgtgggagccagngacagctgcggcgagagctaccgaagggac

SEQ ID NO: 54169 - DNA, 101 bp, rice(Oryza sativa)
  misc_feature (71): n=t or c
tagcatcccagggaccaatcatataaaaaattgtttaggcattttaagtttaaactaggaaggtagcccgngcatatgcgcgggtatgtgcgtaaaatttt

SEQ ID NO: 54170 - DNA, 101 bp, rice(Oryza sativa)
  misc_feature (71): n=t or c
acgcacggcacacgcaggccccctctacccaaataaaacctcaccccctctcgcttcgggtgcgcgacccngtctcctctctctccgcctccaacccccac

SEQ ID NO: 54171 - DNA, 101 bp, rice(Oryza sativa)
  misc_feature (71): n=t or g
gactttacagaaaatgctaaaaaggaaagtatatatatacagtaaaataagtttgcagttttgggattgtnctacctacttggctacttctctcttggaac

SEQ ID NO: 54172 - DNA, 101 bp, rice(Oryza sativa)
  misc_feature (71): n=t or c
cttacttcctccatcccataatataaaagactttggagaaatgtgacacatcataatagtttatagtttanagtatgtatgtatggagcacttttctaggt

SEQ ID NO: 54173 - DNA, 101 bp, rice(Oryza sativa)
  misc_feature (71): n=a or g
aaatagtttttaaaaacattagtacttcaccatttggttgtttttagtttatcaaccatagccaaaatttnaattttcaaacttaattttagagttgattt

SEQ ID NO: 54174 - DNA, 101 bp, rice(Oryza sativa)
  misc_feature (71): n=t or c
ttgtaacttttttttcggaaaccgatctctaaggaactctgaagttgcttggcctggagcaatttagggangggtgaccgatcgggaaattcttctcgact

SEQ ID NO: 54175 - DNA, 101 bp, rice(Oryza sativa)
  misc_feature (71): n=t or c
caacggaccacaggaaacgggtctgaaccaactgaaagcacgaaaccaatccgtttagaacgtgtgggccnattaagaaaccctgaataactaggcacact

SEQ ID NO: 54176 - DNA, 101 bp, rice(Oryza sativa)
  misc_feature (71): n=c or g
ctaatttttacagcaaaaaagtgaaaaaagaaggggggaacctgtaccttccgtaacggtaattgtaggantgagatggctggagaccggtcatgagtgcc

SEQ ID NO: 54177 - DNA, 101 bp, rice(Oryza sativa)
  misc_feature (71): n=a or g
ttgtggcgcacatgtatggtacggaacagtaaactaatatttggaatacttatgttaaaaatagaattgangccatttaagcgagcatggaaaatgtaggc

SEQ ID NO: 54178 - DNA, 101 bp, rice(Oryza sativa)
  misc_feature (71): n=t or c
accattgtcacccttttttaccccatttcaactacaaacctattcgaataaaatgggtaatatagagattngatgcatcaatttcattggactaacctgtt

SEQ ID NO: 54179 - DNA, 101 bp, rice(Oryza sativa)
  misc_feature (71): n=a or c
ttcaaagactcgaatcggaagaggaatttggatgagggggaggatttttttgatttcgatgagagggaacnacgggattaaattgggatccttggcacaac

SEQ ID NO: 54180 - DNA, 101 bp, rice(Oryza sativa)
  misc_feature (71): n=t or c
ccgattaattaattaagataagagtaaagtttgaattaacttgcactattgggtgagtacgatttaccctngtaaacccgaaaaccagatatcttttaccc

SEQ ID NO: 54181 - DNA, 101 bp, rice(Oryza sativa)
  misc_feature (71): n=a or g
ggacccacatgtcagcaactcctctcttcctctcatacatcactctcctctatagatggccataaggcccncgcagcccaggcacgggctaggcatggccc

SEQ ID NO: 54182 - DNA, 101 bp, rice(Oryza sativa)
  misc_feature (71): n=t or c
tctatctggtatatatattacggattcccattgtacaaatcgtccacccactctttcctcttcctctccanattttacggatcagcgacgacttgtggttc

SEQ ID NO: 54183 - DNA, 101 bp, rice(Oryza sativa)
  misc_feature (71): n=c or g
aatgacttgactttttgcactaatgacactagacggtgttgaaaagattcctttatataaacacgtactcnattggtatcaaaatataacaatttagctct

SEQ ID NO: 54184 - DNA, 101 bp, rice(Oryza sativa)
  misc_feature (71): n=c or g
aatggagtagtagttatccacgatggtcgacaacaacgacaccacggtggcttcgtcagcagccatggcgntggtactgccgccggcgacgacagcggcgt

SEQ ID NO: 54185 - DNA, 101 bp, rice(Oryza sativa)
  misc_feature (71): n=c or g
cactcaaaaatctttctagctccatcacttactgtgccccgtttttgttgcacctccattctgaaatagtnttttcttttttcccttagtaacttctactc

SEQ ID NO: 54186 - DNA, 101 bp, rice(Oryza sativa)
  misc_feature (71): n=c or g
cattggaaggctgttcagtggattttctgatacctttgaggcacaacatatgcttgtttgaaatttggcanggctgctaagggacttattggctatgtgga

SEQ ID NO: 54187 - DNA, 101 bp, rice(Oryza sativa)
  misc_feature (71): n=a or t
cacgctcgggatgttttgatttgatcgatatgattggcgtgcgaattttgtaacagtccaagatttttttnaaaaaaaaaactgcccattttaagaaaact

SEQ ID NO: 54188 - DNA, 101 bp, rice(Oryza sativa)
  misc_feature (71): n=t or c
gtacaggatggaacattatctagtactacgaatctggacaggtcctgtactatgtagctacattttggganggaggaagtagtaattttagagaatttcaa

SEQ ID NO: 54189 - DNA, 101 bp, rice(Oryza sativa)
  misc_feature (71): n=c or g
gctcttgtacttacttggatggacaattcttttagggcgataaagattgtgtctggtaccagagcagttgncagaagcatttagtgagtcgatgattctta

SEQ ID NO: 54190 - DNA, 101 bp, rice(Oryza sativa)
  misc_feature (71): n=a or t
aatactcatcagtatcaaacatgtcaattgccatgaacctccagtagatatagaatgaagatttagttgcnagatagggataatatgagataaaaatatat

SEQ ID NO: 54191 - DNA, 101 bp, rice(Oryza sativa)
  misc_feature (71): n=c or g
catttacgaatacatgcctaatgattcgctggagaaatatgtattttcacatgattctgatacttctcaanaagtcctagtaccaagcaagatgctagata

SEQ ID NO: 54192 - DNA, 101 bp, rice(Oryza sativa)
  misc_feature (71): n=a or t
ccaaaataaaccgattttcttatttttgcatgcgggcattgttggcctcttaaaaatatacttacaagtcnatccttcatcctcttttccctcctctacac

SEQ ID NO: 54193 - DNA, 101 bp, rice(Oryza sativa)
  misc_feature (71): n=a or t
gtgggctgaactccaatgaatacattgccatactgtttcccatagacaagtaggtttttcaccatcagaantaaggttcccaggtggcttgccccagttct

SEQ ID NO: 54194 - DNA, 101 bp, rice(Oryza sativa)
  misc_feature (71): n=a or t
ccctaaatatgtccagtggtacagtaactgagtgtctgagtagctgaaactgaaaggggtacacactaacncacacatagtttggtgtaacagccagtagg

SEQ ID NO: 54195 - DNA, 101 bp, rice(Oryza sativa)
  misc_feature (71): n=a or t
tataagattgttcatttcataggaatttcaatggattcgatatgatttgaatccaaggcattcataaaaanttttcctatagaattaaaattctctaaaat

SEQ ID NO: 54196 - DNA, 101 bp, rice(Oryza sativa)
  misc_feature (71): n=c or g
gaacttgctctatgaataagctggcagaagaatctggaagctagtgggtttgtgtggctggggtatattcnctcccgtggcattcccgatattatcgccgc

SEQ ID NO: 54197 - DNA, 101 bp, rice(Oryza sativa)
  misc_feature (71): n=a or t
acataagaggtacttagttattaccacggagaaaactacagcagaacataaaatctagcaaagtttcaacnctactcccacaagcagctcaactgggattt

SEQ ID NO: 54198 - DNA, 101 bp, rice(Oryza sativa)
  misc_feature (71): n=a or t
acactgctccctgttccaacatagttgaacaataaaggttgtgtacttgtgtttaatatgtgtgccaaaanttttttaaagtatatagacacatatttgaa

SEQ ID NO: 54199 - DNA, 101 bp, rice(Oryza sativa)
  misc_feature (71): n=a or t
ggctttatttggtggtatattaattgtatgtaccaccttttaccatttttctctcttctctctttttctanctttgggtgctagtttcatgtgggacctgg

SEQ ID NO: 54200 - DNA, 101 bp, rice(Oryza sativa)
  misc_feature (71): n=a or t
gcttataatttcaacactaagtcctcatcctaccaagtttaaataactttttttattgaactagtgaaaanatatatatattttaatgggaaaacttgtgc

SEQ ID NO: 54201 - DNA, 101 bp, rice(Oryza sativa)
  misc_feature (71): n=c or g
agaattaaattattcagaatttcagatgcggtttatttaatggacagcaaatttatagggtcatcaacatncacggtgatagatcataattaaataattaa

SEQ ID NO: 54202 - DNA, 101 bp, rice(Oryza sativa)
  misc_feature (71): n=c or g
tgtcgctgcagtttaacaagctagcccggcatgcccatgatggcacgattttgctgttgcttttaattaanaccaaaatagtctttgcttccactggcttc

SEQ ID NO: 54203 - DNA, 101 bp, rice(Oryza sativa)
  misc_feature (71): n=a or t
caatttttttcttttgactggaaggccctacaaatttgttgttagagtgaattattattattttttctgantggattgacacgttgacgccatgtgtgcaa

SEQ ID NO: 54204 - DNA, 101 bp, rice(Oryza sativa)
  misc_feature (71): n=c or g
ctccacttatcaggcgaagcaagagttgacatattcagaagccacccacactagctagtagtagcagcttnttgttgcttttactctcaagggtttggttt

SEQ ID NO: 54205 - DNA, 101 bp, rice(Oryza sativa)
  misc_feature (71): n=c or g
gcaagatgcatgaaacgatatgacaccagtgaaaagtgcaatgtgcaccactatgactggctcacacacanagagattatttagagagggaaaggaatgca

SEQ ID NO: 54206 - DNA, 101 bp, rice(Oryza sativa)
  misc_feature (71): n=a or t
agaatcaacataagaaacactttcataatatagcatccgcatgttgttaaactatccgaattttaaaaaantgatggtcaaagatacaaatgtataattta

SEQ ID NO: 54207 - DNA, 101 bp, rice(Oryza sativa)
  misc_feature (71): n=a or t
aagagacactcaggtcgatcttattccaggcagagacgaagcggttgatgcagcaattttccttttttttnaaaaaaaaaatcttgtttcggtttagtttc

SEQ ID NO: 54208 - DNA, 101 bp, rice(Oryza sativa)
  misc_feature (71): n=a or t
agccatggttgaagtttgggcaaatgtatgtgtttgtgtgcttggttttgctggatgttgagtttgtgtcnatattgtgatgtatttatagtagaaactgg

SEQ ID NO: 54209 - DNA, 101 bp, rice(Oryza sativa)
  misc_feature (71): n=c or g
gctgaaaaggctcggattcttgtcaacaagattccaggtatgtttggatgacagcaatggaaacctctcanttagtcagttgcaaattttttcatacctag

SEQ ID NO: 54210 - DNA, 101 bp, rice(Oryza sativa)
  misc_feature (71): n=a or t
tagcatactttaaaccaaccgctttgaaacaattattcattacgcccattcaagtggtgtacatcattttnaaaaaaaaactatccacgtcaatggacgaa

SEQ ID NO: 54211 - DNA, 101 bp, rice(Oryza sativa)
  misc_feature (71): n=a or t
atgcgtgggcatgctatttattgttcataaaagaaatgctaaaagaaagcctacctgaaaacagtaaaaanataaatatatatatatatatatatatatat

SEQ ID NO: 54212 - DNA, 101 bp, rice(Oryza sativa)
  misc_feature (71): n=a or t
gatggcagccacatgctggagatggatgtataataatcgggattaattgcgatgcctttgcgttgcaaatnttgtgtgtgcttgctccatcccgttcgctt

SEQ ID NO: 54213 - DNA, 101 bp, rice(Oryza sativa)
  misc_feature (71): n=c or g
atacctcgctcgacatgtgcacctggcgcggcgtgacatgctccagcgagctcccaaagcctcgtttggtngtggccttggacatggaggcacagggcctc

SEQ ID NO: 54214 - DNA, 101 bp, rice(Oryza sativa)
  misc_feature (71): n=a or t
aaaaaaatatttcttcatttgtttgtgtgagggaggaaaggttacagctgattctaggtgggcccgtaaantgatgctagtgttgtagcatcggaaccaaa

SEQ ID NO: 54215 - DNA, 101 bp, rice(Oryza sativa)
  misc_feature (71): n=c or g
aatttatgtaagtcataagaaaggtcttaaggctaacttattatagtagaacatatcttcttcgttcaaanattgtagtagaacatattgtttcttcaatg

SEQ ID NO: 54216 - DNA, 101 bp, rice(Oryza sativa)
  misc_feature (71): n=c or g
aaatgaataaaaataatttatttaaaaaaacacaaaacatatatatgggacgtgaggaccatatgatgtgnccgagcacatgaaagattagactcatttta

SEQ ID NO: 54217 - DNA, 101 bp, rice(Oryza sativa)
  misc_feature (71): n=a or t
tatataagagcaaatagctagaccctttttcaaatagctataaccgagatttaaaacctcacttttaattntattcttaaaaaataaacctgaattttaat

SEQ ID NO: 54218 - DNA, 101 bp, rice(Oryza sativa)
  misc_feature (71): n=a or t
gtaccagccaacacagaagggacagatcggcatggtggtggtcacccactggttcgtgccgtacgacaacnccgacgctgaccgtggcgctgtgcaacgga

SEQ ID NO: 54219 - DNA, 101 bp, rice(Oryza sativa)
  misc_feature (71): n=a or t
gcggtcgccgagggtatcaaacgaagtggtgtatcaaactaaactaccaaaaactcaccgcgagacgaaanggggaagcgggggaattcgtcggcggaaga

SEQ ID NO: 54220 - DNA, 101 bp, rice(Oryza sativa)
  misc_feature (71): n=c or g
cacgctcatggcgaaggcagcaacaacgacaagcaagaagaagatgaagaggaggttgggtcgttggggcngcgggtgttggtggagagcaagaagctgtg

SEQ ID NO: 54221 - DNA, 101 bp, rice(Oryza sativa)
  misc_feature (71): n=a or t
tccaaaatgccgcatatagacacacgaaggataggccgtcaggtttctagtgaccactcacaatttttttnaaaaaaaatacattttttttgcagaaaatg

SEQ ID NO: 54222 - DNA, 101 bp, rice(Oryza sativa)
  misc_feature (71): n=a or t
ttttgcacggcctttacgcattgactggattatattgttgcaccagtacatgttgagaacactcacatttnttataaaggcagcagaagggacaaacgcta

SEQ ID NO: 54223 - DNA, 101 bp, rice(Oryza sativa)
  misc_feature (71): n=a or t
ggcaggtcgctattgcgaaattatgtttttcataattggatatgggaacttaatgccatgtgtcttttttnaaaaaaaatcttattcatttatattatttt

SEQ ID NO: 54224 - DNA, 101 bp, rice(Oryza sativa)
  misc_feature (71): n=a or t
tagtgactgccgattctacgctagtgttacttttgccatgattcaacaaaaagtcgctacgatttttcacntaatatatagtttatttttccacttagttg

SEQ ID NO: 54225 - DNA, 101 bp, rice(Oryza sativa)
  misc_feature (71): n=a or t
aattcttgcaggggcaacaatgtaccttcacagggttgatgcacgaaataatgcaaactccaaaaagtgcnataaatgctgatcaagattatttgggcatg

SEQ ID NO: 54226 - DNA, 101 bp, rice(Oryza sativa)
  misc_feature (71): n=a or t
tatctttgagccatataagatttgtgattgaaattttataaattagcctgtgacgaaacattgattttttnaaaaaataagaaaatgatagtgggatgaaa

SEQ ID NO: 54227 - DNA, 101 bp, rice(Oryza sativa)
  misc_feature (71): n=c or g
atcatgcatcgatcctccccgatgcaccgctataggaagtagccgaataccacaccaaacaaggcaagcgncaccgctgccttcctgccggccatggagct

SEQ ID NO: 54228 - DNA, 101 bp, rice(Oryza sativa)
  misc_feature (71): n=a or t
cgagaggctaaggctcaaaggataacaaccagtaccggtcgagtaaccctatcctcacctcacctgtaacngtaatacggtaattcaacccataacttata

SEQ ID NO: 54229 - DNA, 101 bp, rice(Oryza sativa)
  misc_feature (71): n=a or t
ccatgcgaaaagataaaattttcatttgattagatgaacgagaacagataagtagtacagctacatgattntgtttttctttctcttttttaagatataaa

SEQ ID NO: 54230 - DNA, 101 bp, rice(Oryza sativa)
  misc_feature (71): n=a or t
ttctgtcagattctggctaaattgtccttagtcttgcctagtttctccccccaaaattaaaccgcagaccnaatggattagaatagagcccataatttgtc

SEQ ID NO: 54231 - DNA, 101 bp, rice(Oryza sativa)
  misc_feature (71): n=c or g
tgctccgtgccacttgatgggctacaacttctgtagacgacgaacggatgcctcacagcaactcaaacccngcctcggatacatcacactcctcgaccgga

SEQ ID NO: 54232 - DNA, 101 bp, rice(Oryza sativa)
  misc_feature (71): n=a or t
ctcacatcttctcttccccctccccttctttctccgagggaacaatggtgttccagtggagcagaagagangaagagcactgatgcaccacggcggagagg

SEQ ID NO: 54233 - DNA, 101 bp, rice(Oryza sativa)
  misc_feature (71): n=a or t
aacaccgacacataaaagtcaacgcccgacttttccggctagttgttgttttaattatcgagaaaagtcanctgcctaccaaaacaacgagttcttgatct

SEQ ID NO: 54234 - DNA, 101 bp, rice(Oryza sativa)
  misc_feature (71): n=c or g
ggtcaaaccaccagtttaaaatggtttaaataaatgtgtgctacaatactaccacaataggcgacatgccntggtggatgagtctttccatgggaacaagg

SEQ ID NO: 54235 - DNA, 101 bp, rice(Oryza sativa)
  misc_feature (71): n=a or t
gagactgatcgagagctaggtttcctaagctagctaccgccaactaacatctcgatctctttcataacttnaaaaaaaaacatctcggtcatgccctccaa

SEQ ID NO: 54236 - DNA, 101 bp, rice(Oryza sativa)
  misc_feature (71): n=a or t
aacaagtaagggctgcagcaggccaggatacctgaacctgtctggcttagcttgctgacagatggaacacnccttgaccttcagcttaatctgcttcttca

SEQ ID NO: 54237 - DNA, 101 bp, rice(Oryza sativa)
  misc_feature (71): n=a or t
gctgagctgagctgaaagaaagccccacagccacagcaccactactctcttaacactgcactgtagtatcnctttgtaagcagcaatgcagcagcagatat

SEQ ID NO: 54238 - DNA, 101 bp, rice(Oryza sativa)
  misc_feature (71): n=a or g
acatgagaactattattagttgcgatgcacttagcatgtttgatggttttacttttcaggacagggaacantgactgcttgttgaactaagctacaacaat

SEQ ID NO: 54239 - DNA, 101 bp, rice(Oryza sativa)
  misc_feature (71): n=a or g
cttatttgctacaaaaatgttgatcacgatactaattcacttggcggtctccaactcattcaccaggttcnactgaacttgctgccgttggagtatccatt

SEQ ID NO: 54240 - DNA, 101 bp, rice(Oryza sativa)
  misc_feature (71): n=a or g
agtatgtcatcaaaaaagactagggcacactttcttaaaactgaagacaaggttgcattcatagctccctngaaggtggctggtgctcctgtcagtccaaa

SEQ ID NO: 54241 - DNA, 101 bp, rice(Oryza sativa)
  misc_feature (71): n=a or g
tgttctcttgactgagtttaaaatttggaacggattagggtctcttatctgcagcccaccgaattcgcttntgcgaactagcatgtgaaagctcatctttt

SEQ ID NO: 54242 - DNA, 101 bp, rice(Oryza sativa)
  misc_feature (71): n=t or c
ggcatgatctgatttactccacttttcaggaaccaaacgagcaaattgcttggttcaatgattcctggagnaataactcgtgctttggatccagcaaacca

SEQ ID NO: 54243 - DNA, 101 bp, rice(Oryza sativa)
  misc_feature (71): n=t or c
ggaaatacaatttctgttgtcaattattgtcggattcgtagtgctaatagttgcattgtgtcttggtgganaggtttgctttcgggtgcaatcaactttct

SEQ ID NO: 54244 - DNA, 101 bp, rice(Oryza sativa)
  misc_feature (71): n=t or g
tgaaaagtgcagagtaagcccaagaatgaggagagttatgcccatgatagaccactgctttagtctgtccntgtggctctgtggtttcaggaaaaataaac

SEQ ID NO: 54245 - DNA, 101 bp, rice(Oryza sativa)
  misc_feature (71): n=a or c
tgtggcctgctttcagatgaaacagcagaaacctattcatggctatttaaggcttggatagcatgcatgtntggtaatcttccaaaggctatcatcactgg

SEQ ID NO: 54246 - DNA, 101 bp, rice(Oryza sativa)
  misc_feature (71): n=t or c
caccctagcgaagaggagcttttgtgtggaaaggaaggagatgtcaaggactttctgcggttgaggaattngtccccgttgccgttcacatgccccgtcac

SEQ ID NO: 54247 - DNA, 101 bp, rice(Oryza sativa)
  misc_feature (71): n=a or g
ttagttgtttggacaagagggggcatacattttgtgtacagaggaagcagttacctagaaaacgcaaagcngcatcgtgactttgttaattataatgagga

SEQ ID NO: 54248 - DNA, 101 bp, rice(Oryza sativa)
  misc_feature (71): n=a or g
tccttctcctccgtgctcacactagggatgatgatcacattgtcgccattggtgatactgtctaccttggngttggaggtgatagatagaacttgttctac

SEQ ID NO: 54249 - DNA, 101 bp, rice(Oryza sativa)
  misc_feature (71): n=a or g
aaggggaaccacgtggtgaggatgaatttaactacgttgttgtcggacaagttgaagcctcgaaggcggantcgcgggatgggctggtgatatagagaaga

SEQ ID NO: 54250 - DNA, 101 bp, rice(Oryza sativa)
  misc_feature (71): n=t or c
gagactaagtaaagttgacatccagatggggaatgacaaaatatgtacgctcgaagtgcatacaagatgcntgttgatgacttcaattgctttctcataat

SEQ ID NO: 54251 - DNA, 101 bp, rice(Oryza sativa)
  misc_feature (71): n=t or c
accataaggagaatggagttgcttagcttttgttatctgggacggtgcttgcttcttacctctgttgagangatcccctcgttcacaccgactagtccata

SEQ ID NO: 54252 - DNA, 101 bp, rice(Oryza sativa)
  misc_feature (71): n=t or c
gcttgatggagacatgtgcaaccattagcgtcgtaatacggagcatctggacaatgatgcacaagctctcnagcaacactaacatagccacggtatgcggc

SEQ ID NO: 54253 - DNA, 101 bp, rice(Oryza sativa)
  misc_feature (71): n=t or c
agtggggaagttggagttgaagtgggaaggcccctacctcattgtgcattggtcaccaagaggatggtttngactggcaacaatgggggtgaagagcttga

SEQ ID NO: 54254 - DNA, 101 bp, rice(Oryza sativa)
  misc_feature (71): n=t or c
caacaaagcccaccgccgtcttgtgatccctcggcaacattttcttggcctcgtcctccaacccgatcgcngccgctctcttccatcctcgaccgctttcc

SEQ ID NO: 54255 - DNA, 101 bp, rice(Oryza sativa)
  misc_feature (71): n=t or c
ctttttccattattatcagtatttgttgagtgtgcatagttcacctgaccagctttggccagtgcctgatngacggcgtccttcagttgattcatttctgc

SEQ ID NO: 54256 - DNA, 101 bp, rice(Oryza sativa)
  misc_feature (71): n=t or g
tggtcttcttcagagatgggggttcgaacatctgggatgttttacataggcgccccctttttttcggtggntctgaagaagctagcctatggtgttctgct

SEQ ID NO: 54257 - DNA, 101 bp, rice(Oryza sativa)
  misc_feature (71): n=t or c
caaaaaaagattaagacaaaaaagcatcaatacattcaactacaaaccttaaatatcttgattgtgatacncagagtgccattagttggctctaaaatatc

SEQ ID NO: 54258 - DNA, 101 bp, rice(Oryza sativa)
  misc_feature (71): n=t or c
agaatatggtctgcgggtatcccctgtctaggcttatctttgatgccgaatttcgacaccgtcaaactttngctccagcttcctgacatcggtgaggtatt

SEQ ID NO: 54259 - DNA, 101 bp, rice(Oryza sativa)
  misc_feature (71): n=a or c
aaatacggaaagagaatacgcaatcatatatctgaccaagtttttctgaacgtgttatatgtttttttttngtgagctctgaactgaaattgacatgtcta

SEQ ID NO: 54260 - DNA, 101 bp, rice(Oryza sativa)
  misc_feature (71): n=a or g
gagagggggggtggtggcttgatacaaaggggaaaggaaggagagatgggcaaaatggattcgctggagtngagccagcatagtggcgcaagggaagagga

SEQ ID NO: 54261 - DNA, 101 bp, rice(Oryza sativa)
  misc_feature (71): n=a or g
agcttggtgaagctgtatcaaattaggatgatgcctgctgctaggatgccacaggttgtcttggccgaccngtgtgatcggcctacatgagtgcattgctt

SEQ ID NO: 54262 - DNA, 101 bp, rice(Oryza sativa)
  misc_feature (71): n=t or g
tctcataagcacttggcgacccacttggtacaccagaaggtaaacaacatttgtgcatggactcaagcaanctaaccattagctcatgtgcgtcttcctgc

SEQ ID NO: 54263 - DNA, 101 bp, rice(Oryza sativa)
  misc_feature (71): n=a or g
tgtggatcaccctctgatgagtactggcagaaactgaacgtgccccagacagggatgttcaagccctctcnccagtataggcggtgtattgcagataattt

SEQ ID NO: 54264 - DNA, 101 bp, rice(Oryza sativa)
  misc_feature (71): n=a or g
aattaaaatttgcctccttattcaccaagacgttaattaactttactttaggtttccagtagtactagttnattaagttaagtagcaaattaacgacacgt

SEQ ID NO: 54265 - DNA, 101 bp, rice(Oryza sativa)
  misc_feature (71): n=a or g
aacaccggcccctggctctgatatattggaacttgtcgatgatgccattgtgttccgacctgttgacttcncgccattcaggaagacggttacagattgca

SEQ ID NO: 54266 - DNA, 101 bp, rice(Oryza sativa)
  misc_feature (71): n=t or c
tttcctgaatggtttctcagtgccgtaaacatgaccgtccacttttctgacgctaggcatatctgagatgngcaatacttccagatttgctaattggccaa

SEQ ID NO: 54267 - DNA, 101 bp, rice(Oryza sativa)
  misc_feature (71): n=t or g
cggagtggggtgccccctgcgatcatcttgattctcttggtcttgacaagaatggccgacggggtagagcnggggctgcatgaccgtggcgcgcgagccga

SEQ ID NO: 54268 - DNA, 101 bp, rice(Oryza sativa)
  misc_feature (71): n=t or g
agcgatgcaattgtttccttccgtttatgactctacttctttcactcagaatgttgacatcggaatggatnctgattcattaactcagcttgcctctacat

SEQ ID NO: 54269 - DNA, 101 bp, rice(Oryza sativa)
  misc_feature (71): n=a or g
tttagcttctcaagcagcacgatcaaggcctcgcgatctctttcttttgacagcagcaccttccatctctncatcaaagaaattgccttgtacactacctg

SEQ ID NO: 54270 - DNA, 101 bp, rice(Oryza sativa)
  misc_feature (71): n=t or c
cttcctagcatctcttacccgaagacagtgagggctacctggaacttccacgattctttccagaaattttngggttctcgctcctcgagactcacgtcttg

SEQ ID NO: 54271 - DNA, 101 bp, rice(Oryza sativa)
  misc_feature (71): n=a or g
agagggctgatggagatcaggaatggaaataatagcgatttccagatcagaatggatcggcaatcagtacncagtaaagctggagcagttaaaaggaaggg

SEQ ID NO: 54272 - DNA, 101 bp, rice(Oryza sativa)
  misc_feature (71): n=a or c
tagcacgccaagcgtgatatttggtgcagtttttcttcatatgtccttccttcttgcaaaaataacagggntcctcgccacagttattttcccttttcttc

SEQ ID NO: 54273 - DNA, 101 bp, rice(Oryza sativa)
  misc_feature (71): n=a or g
gaagtacgtgctgttctacgtgcgcctcaagtccaagtacctcgacctcgacctcaccaccgccatgttcngcgtccccgaggcccgccgcgccgactacg

SEQ ID NO: 54274 - DNA, 101 bp, rice(Oryza sativa)
  misc_feature (71): n=t or g
actgcaaccaccttttcgtccgtaaatttcccttgatacacagaactataccttcctcttccaattaaatntgatgttgaaaacccctctgttgctttggc

SEQ ID NO: 54275 - DNA, 101 bp, rice(Oryza sativa)
  misc_feature (71): n=a or g
gtctcttattggagatggaatattttgtggcgagaatcgagggatctcaggcatatcatcaaagtgtgacntgcctgcttcgcctggagactttgggttga

SEQ ID NO: 54276 - DNA, 101 bp, rice(Oryza sativa)
  misc_feature (71): n=a or g
tgctacaacacctcaccggtttgagccctaaatttggacatatgcaatctcttctatccatgcagaagccnttcccctccttcctggatgctcgctctcag

SEQ ID NO: 54277 - DNA, 101 bp, rice(Oryza sativa)
  misc_feature (71): n=t or c
tcttcttcgataaatcggattcgctggatgttctaaacgagtggctaaatgtgcttcaatcaattcagatnccttttgccctgattccgctgataactttg

SEQ ID NO: 54278 - DNA, 101 bp, rice(Oryza sativa)
  misc_feature (71): n=t or c
aatgtctctagtgcctgcatctttgcaatgccatctgggagttgaatctgattgccaataaatagatgcancaaatttccaagtcgtgtaatacattgtgg

SEQ ID NO: 54279 - DNA, 101 bp, rice(Oryza sativa)
  misc_feature (71): n=t or c
gcacacctcgaggacagagtttatcagagcaggattcgcggaagttgggcctatagtctcatctatcaacngcttaagcctgtgcttcttaacattcttca

SEQ ID NO: 54280 - DNA, 101 bp, rice(Oryza sativa)
  misc_feature (71): n=a or g
gctagttgctaatgaaagattgaaagaaaattaccatttctgatataaacaccctcaggaaaatcatctgngatcgtcccttctatcctccatatctctgt

SEQ ID NO: 54281 - DNA, 101 bp, rice(Oryza sativa)
  misc_feature (71): n=a or c
tataaccgtagcgttagtacgggcatattactagtctctcttagttgacacggtcaaaccggtcatcagcngagtcccatgggagcactttacctcgttaa

SEQ ID NO: 54282 - DNA, 101 bp, rice(Oryza sativa)
  misc_feature (71): n=a or g
tcacattgtagttagtatgcaatccattcatgcccctgaataaagttctctactgagtagactcctacaanttgttctggtgcctggctgctccactcaac

SEQ ID NO: 54283 - DNA, 101 bp, rice(Oryza sativa)
  misc_feature (71): n=t or c
gtggacagctgcgccaggcagctgttgagcatgatggtggagaagaagatcgggagcaccatgagcacgancttgacgtcctccacctcctgcaccgtgca

SEQ ID NO: 54284 - DNA, 101 bp, rice(Oryza sativa)
  misc_feature (71): n=t or c
tgctagcctgtgcaggagtaccaccttcttgcatacaaagacgttcactcctgactttgggatattatggnaagtggataaatcatgattctgtacgctta

SEQ ID NO: 54285 - DNA, 101 bp, rice(Oryza sativa)
  misc_feature (71): n=a or c
cgcagagcagcatctgctgccgctcgaacagctggaattatgcagcagtcggaggacacgaagattgcttnctctaaccccaagaccaggcgtctactacc

SEQ ID NO: 54286 - DNA, 101 bp, rice(Oryza sativa)
  misc_feature (71): n=t or c
ttcctccattttatgagatttccaatctcagtgctaacttccccaatctcctcaacaccaagatgtacggnaggcagtttcttggggacaaacacctgctt

SEQ ID NO: 54287 - DNA, 101 bp, rice(Oryza sativa)
  misc_feature (71): n=a or g
gctctcctatcttatatatagaaagaagaggtagcaggaaaccacatcccttcttcaacgatggaagtaanatctttaaatttgtgcttcctcttggttct

SEQ ID NO: 54288 - DNA, 101 bp, rice(Oryza sativa)
  misc_feature (71): n=t or c
taacctcaagtagactgggttatttatttatatctaccactaagaggaggaggcagggcgaggagaaagangtgttggccgtaaggaagagggagtaaaag

SEQ ID NO: 54289 - DNA, 101 bp, rice(Oryza sativa)
  misc_feature (71): n=t or c
taaaagctgtaaaatacccacctttttttgggggtccccctcaatataatctctaggcttgtgttgggatngccaaccctctctcctgtcatgcatgcata

SEQ ID NO: 54290 - DNA, 101 bp, rice(Oryza sativa)
  misc_feature (71): n=t or c
tagtattacatctctagagttgttagtctttttggtagactagattactggcaagagggagatgtaatccnaggaagggttatacttcgagcttattttga

SEQ ID NO: 54291 - DNA, 101 bp, rice(Oryza sativa)
  misc_feature (71): n=t or c
tcttccgcatctgtacaggcattcacttgctggatgtgtttgatcttctcccactcgggggtgcctttccnccgggagatcagggtgagaagatccaagtt

SEQ ID NO: 54292 - DNA, 101 bp, rice(Oryza sativa)
  misc_feature (71): n=a or g
aaaaaaaagtattccctttgttcttttgtagtgatactccagacattctacagtctctagacaagatagancattagtttccttatattagagtcgacaac

SEQ ID NO: 54293 - DNA, 101 bp, rice(Oryza sativa)
  misc_feature (71): n=t or c
taccaacttgtataatagtaagtgaagctaaactttgggcaaggtaacaacaaacctttccatactgcacnttcacatatggatcacactttccagattta

SEQ ID NO: 54294 - DNA, 101 bp, rice(Oryza sativa)
  misc_feature (71): n=t or c
aaggttgatttcttcaggaagatgccatcgattaccgtgctgtcgaagtaggtcgcccagaagcgagcggnggcgcggtcgtgggggtcggccgggaggag

SEQ ID NO: 54295 - DNA, 101 bp, rice(Oryza sativa)
  misc_feature (71): n=t or c
actctcattcctcctgatgagcctaacaattggactgttttctgggaaggattcatatctgctcacatccntcctggtctcatggagatcaaaaagaaaga

SEQ ID NO: 54296 - DNA, 101 bp, rice(Oryza sativa)
  misc_feature (71): n=a or g
tcttctctatccaaagtacaatgaagtcatcatcttggattccctcgacaatgatagcaacacctatcagnaatttctaagaattcttgatctgtaagtaa

SEQ ID NO: 54297 - DNA, 101 bp, rice(Oryza sativa)
  misc_feature (71): n=a or g
cggcgcaaaaaggaagatgttcttggcaactcgttatatgtgccaaaagagtgagattcagtgttttcacngagagaaatttgtctccgaagattttgctg

SEQ ID NO: 54298 - DNA, 101 bp, rice(Oryza sativa)
  misc_feature (71): n=t or g
tcgatcgctcaagtgtgcaaccttgatctgcgaaaagaagaagaaaaacatagtgtggtgtgcgtgtgtgngtgtgtgtgtggggggggggggggggggtt

SEQ ID NO: 54299 - DNA, 101 bp, rice(Oryza sativa)
  misc_feature (71): n=a or g
agaaattgtacctcaaagtgatagcttgagtacctcatagatggcttgataacttgcacttcccttgtgtntcacattctgaatataatacattgcaaatg

SEQ ID NO: 54300 - DNA, 101 bp, rice(Oryza sativa)
  misc_feature (71): n=a or g
atagcagattcctcggtcagttgcctggtgagtcctaaaagtgggttttcaatatttgccgttggagactncactgtaacgccatggcgggcttgcggggt

SEQ ID NO: 54301 - DNA, 101 bp, rice(Oryza sativa)
  misc_feature (71): n=t or g
gcaccccgatggtcgcaccaagactcttggcaccgagctcatatgactctcagatatcaatataacaatcnaaacaagttcagatatcaatataacaaaca

SEQ ID NO: 54302 - DNA, 101 bp, rice(Oryza sativa)
  misc_feature (71): n=a or c
tttagcaattactagaaaaccatgaccccttgtaatacttaggtttggcatacaagaacaatactcacaanaccctccataagaaggtctgcagctttagc

SEQ ID NO: 54303 - DNA, 101 bp, rice(Oryza sativa)
  misc_feature (71): n=t or c
atgaatcttcactgaagaatcttcagtgaatcttatttggccacttgtaaatttcagcttactataaggcnctgtttagttcccagaacaaaaattttcat

SEQ ID NO: 54304 - DNA, 101 bp, rice(Oryza sativa)
  misc_feature (71): n=t or c
gagcagctgaaaaatgtaaggacatacatcatgcatgtgcgggatgttttgaactgagcaggtttaggganattttgatcaaatgtaatgttatttttgta

SEQ ID NO: 54305 - DNA, 101 bp, rice(Oryza sativa)
  misc_feature (71): n=a or g
cgggggagtgtcggtgcggggaagaaggaaaaagaaaggaaaggagcgcaccaactaacgctctcccaaanaaaatactaaacgaaatcgaaatgatttgg

SEQ ID NO: 54306 - DNA, 101 bp, rice(Oryza sativa)
  misc_feature (71): n=a or g
acacattcgcttgctacgatccatttcccaactgtattaagggctaatcactatgcaaaactgttgtattnagggctcaaagccgcgtactaagttatcaa

SEQ ID NO: 54307 - DNA, 101 bp, rice(Oryza sativa)
  misc_feature (71): n=t or g
caacttcaagcaagtgtagaagtctaaatcaacttcaagctcctcccatattgtgtcatggaggacaagcngccgctggctctgaccgtactgtcagtgtc

SEQ ID NO: 54308 - DNA, 101 bp, rice(Oryza sativa)
  misc_feature (71): n=a or g
ttggagaagaaatttaaagccagatttgagtcatggattgacttttcttttctttcctggcatctgccaanttttgtatattattttagttctattttttt

SEQ ID NO: 54309 - DNA, 101 bp, rice(Oryza sativa)
  misc_feature (71): n=a or g
cgcagcccggaaaaaggctcccaattttttctctccccatactgcccccgccacttccacgtaaaccacgncaccctatgcccgaacccgtggctcacgtg

SEQ ID NO: 54310 - DNA, 101 bp, rice(Oryza sativa)
  misc_feature (71): n=t or c
ctcctatacaattgctatacccccgtcctttccttgaaccgttgggataccatagttaaatcgatccaccnaacatatgtcttgatccacctaaaggatgt

SEQ ID NO: 54311 - DNA, 101 bp, rice(Oryza sativa)
  misc_feature (71): n=t or c
cagaaaccatgcaatcatgtgcactgcacgagatgaagcatccatggatatggaaataataacagcaattngctggtcgtaggacctgctaaggccagagc

SEQ ID NO: 54312 - DNA, 101 bp, rice(Oryza sativa)
  misc_feature (71): n=t or c
tgggaagatatgagtcctactttaactgatcgaaacagaaccagcgtgccctctttacctccccttggaancctgagagctggatttcttgggccaaacag

SEQ ID NO: 54313 - DNA, 101 bp, rice(Oryza sativa)
  misc_feature (71): n=t or c
tttctcagcaaacaagtgcctaagctttgtcagcttgacaatgcctctaggaagctccagtatgctagatntgaagaggtctagtgttaacaggttggtta

SEQ ID NO: 54314 - DNA, 101 bp, rice(Oryza sativa)
  misc_feature (71): n=a or c
ctaacttgttttgtacttgaaatcctcggatgaggcaaagaaagatagctctttgaatatgatgagggcanaacaaatgccattggttttcactcgctgaa

SEQ ID NO: 54315 - DNA, 101 bp, rice(Oryza sativa)
  misc_feature (71): n=t or c
ttaaggaatttagtggagataggcatcctattcataggttcttcgtatttaattactcctactctctccgntaaaaaaaaagacaatctagaagaagatgt

SEQ ID NO: 54316 - DNA, 101 bp, rice(Oryza sativa)
  misc_feature (71): n=t or g
caatcataagactataagtccacagggtgtgcgcgcctttttaatagtgagtacgcatgcagttacacatntaagtatatgcatctgtaatgtatttgcaa

SEQ ID NO: 54317 - DNA, 101 bp, rice(Oryza sativa)
  misc_feature (71): n=t or g
ttgctactatgtgcatcaagcttcattagttgtagtttggaactgcaggcatgattccataaaaacgtccncggggaattcaaggaaaaactgactgtgag

SEQ ID NO: 54318 - DNA, 101 bp, rice(Oryza sativa)
  misc_feature (71): n=t or g
aaataatactgtcgtgagcactcagattccaacattagctgaatcagaagatagaacacccgccgatactnctattcaaggtactccatacaatgttcttc

SEQ ID NO: 54319 - DNA, 101 bp, rice(Oryza sativa)
  misc_feature (71): n=t or g
cgcttctggccctggttttgatttttgaaatgttgatgtatcggatcatatcggagatcaaaacagaaaanggaataatggtcgatgcaaactaacttcta

SEQ ID NO: 54320 - DNA, 101 bp, rice(Oryza sativa)
  misc_feature (71): n=a or g
aaaccgccaaagcccttcaatgtgcttcctcactactatcatgaaaatgtctcgatggcaaacctatgcangttgcatggatggaaagtcagggaaactcc

SEQ ID NO: 54321 - DNA, 101 bp, rice(Oryza sativa)
  misc_feature (71): n=t or c
catgatttttcactctcatagtctcattttcttctccctcagctctctagtctctctctctctctattttntctataataatctctcatatgttctctgta

SEQ ID NO: 54322 - DNA, 101 bp, rice(Oryza sativa)
  misc_feature (71): n=t or c
atgatgctaactgttaggcactattctttcctggcccatctcaaccatgctcctgaaccgctcaaaatacngagaccgtagaaatatgaatagaacatgaa

SEQ ID NO: 54323 - DNA, 101 bp, rice(Oryza sativa)
  misc_feature (71): n=t or c
ctcactattttcttcacagcaacctcacgctccagctgcttcaggaaaccactatagactaccctaaatgngccttccccgagcttgcgatcgtcggagaa

SEQ ID NO: 54324 - DNA, 101 bp, rice(Oryza sativa)
  misc_feature (71): n=t or c
cagaaatacagaagaagtttgagctctctcacaaaatagaagtgcagaagaagtttgagtttgcggcacanggaggatggggcggaggtgaaggtcgttct

SEQ ID NO: 54325 - DNA, 101 bp, rice(Oryza sativa)
  misc_feature (71): n=t or c
tactatgatttgtgatgtcgcgcttgaaaattcgatttgtgatgtcgcgtggtgcggactgcatgtggagnaacacaatatttttcccctttgtgatttga

SEQ ID NO: 54326 - DNA, 101 bp, rice(Oryza sativa)
  misc_feature (71): n=t or g
gtcacttatgattgctgcagctaagtattgatcgcgtaaattcctttatcggccagttatccgcaacaatnctaggcctaggttggcctgtcatttttttt

SEQ ID NO: 54327 - DNA, 101 bp, rice(Oryza sativa)
  misc_feature (71): n=a or g
cttagtgcggcatggcctcacatgatcttttggctaaaacaactacggtggcgtcaccatgacggtgacancaacgactgggttagaggtgaactcgagtt

SEQ ID NO: 54328 - DNA, 101 bp, rice(Oryza sativa)
  misc_feature (71): n=a or c
cccaccgcctttaccaaaaccgccaccaaatccaccacctttaccaaaaccgccgcccttgccgaaaccancgccaacccctccgcctttgccaaacccac

SEQ ID NO: 54329 - DNA, 101 bp, rice(Oryza sativa)
  misc_feature (71): n=t or g
atggtttgattttagacgaattccaaaggtactaaagtgaacgtcctttatttccaagtcccattatttcncttattcgtatacttatacgaatctcttat

SEQ ID NO: 54330 - DNA, 101 bp, rice(Oryza sativa)
  misc_feature (71): n=a or g
ctcgtcttcgggggctcgtaatttggcctcacgttgtagtttcatattttgatgcccagacaatctaaagnaaacaaaaacatgcctcatatctagcgaca

SEQ ID NO: 54331 - DNA, 101 bp, rice(Oryza sativa)
  misc_feature (71): n=t or c
gatgtcttcataaattctagcatcctccgtagctggaaagactctatcattgttctccagagcacaaaagnactattaccttggtccgaagagctgaaggt

SEQ ID NO: 54332 - DNA, 101 bp, rice(Oryza sativa)
  misc_feature (71): n=t or c
agtctgatgtacactaaatgtttcaaatagacaagatgcgtggatgcaatgcacaagtagaatagaagatntggatgacaattctaatcttcatgatttgg

SEQ ID NO: 54333 - DNA, 101 bp, rice(Oryza sativa)
  misc_feature (71): n=t or c
cgcgtggaaggtggttggcatgcaaggtgtggccaaagtcataatcagatctcagcttctcagcaacctcnatgaagtttgtatactcagtgccacttaat

SEQ ID NO: 54334 - DNA, 101 bp, rice(Oryza sativa)
  misc_feature (71): n=t or c
aacctcgtttgcacagatagattcaagagaagagctcaagaactttatgatggtgggcaaaccgctgcatntctctgcgaccttcctcttactcaattctt

SEQ ID NO: 54335 - DNA, 101 bp, rice(Oryza sativa)
  misc_feature (71): n=a or g
tgacaaggccactcaggtcagttgtccatgcccacgctcttcttttctccaacgaggagcccaaccaaacnacgacaaaggtagtacagccatggcgccac

SEQ ID NO: 54336 - DNA, 101 bp, rice(Oryza sativa)
  misc_feature (71): n=a or g
ggttcccatttccatcacatgatcacgaccgttcatacgatgcaatatatccacgcacctaattaatctanatcgtgactacacgtacggttagccgcgtg

SEQ ID NO: 54337 - DNA, 101 bp, rice(Oryza sativa)
  misc_feature (71): n=t or g
tgacactatgtggtaacccaaaccaacatttttccttctggggagcaaaacaagcggcgccactttattcncaggagtataactgtgtaagaccagttaaa

SEQ ID NO: 54338 - DNA, 101 bp, rice(Oryza sativa)
  misc_feature (71): n=a or g
agcctagctaacgcaccattccctgctatagattctactccatcttttgttgttgttgttgcgctttggcntaaaccaatttcctcgtagtggagtagcag

SEQ ID NO: 54339 - DNA, 101 bp, rice(Oryza sativa)
  misc_feature (71): n=a or g
aacatgtctttttatccccctcatccctcgacttgatttataggtatgcggtttgccaatcctagcttacnaaatctaggatttgatatgcatatgttttg

SEQ ID NO: 54340 - DNA, 101 bp, rice(Oryza sativa)
  misc_feature (71): n=t or c
caatgcaccacaccgccaagttgactcaatgtccttgtttttctccactacctatgcatgaacaagttttnactggaaatgagtatgataatcattcaagt

SEQ ID NO: 54341 - DNA, 101 bp, rice(Oryza sativa)
  misc_feature (71): n=a or c
gcaaaaacttttgtcttcatatatgctttacacctccaaatacaaggcaaagtaactagggttgtagagancaaaagcaaagcttgtagaacttctgagag

SEQ ID NO: 54342 - DNA, 101 bp, rice(Oryza sativa)
  misc_feature (71): n=a or g
catataaaagaggaaatcaaatgctaacttcacatacaccttctttgttgaatatgggcatactaaattanacagtagttatatgtgtgcatatggggatc

SEQ ID NO: 54343 - DNA, 101 bp, rice(Oryza sativa)
  misc_feature (71): n=t or c
cggtgccaccggcgaggaggcgatgaggcgtggcgtggcaacactgtcgatggtgctgacccaagccctgnggctaaggccagtcggggagaccgtgtcga

SEQ ID NO: 54344 - DNA, 101 bp, rice(Oryza sativa)
  misc_feature (71): n=a or g
ctatatactgtagtatgtacaggacgctcatatcatggtgtggaccaatgttgacaacaatgtctccttgnctagctcagcttagctcactcttcctcttc

SEQ ID NO: 54345 - DNA, 101 bp, rice(Oryza sativa)
  misc_feature (71): n=a or g
tttccaagtacaggagggctcgtttggtttagtacatatcaaacattggtagtatactgacaaaatctagncatgtttagcactaacaatattttagtagg

SEQ ID NO: 54346 - DNA, 101 bp, rice(Oryza sativa)
  misc_feature (71): n=t or c
tacaatggcgatcatcccgtcatgtacacggtggtctactacggccagcacacctgctgcaagggccctgnggcatcagctgatgatcatgtcgtcgtcga

SEQ ID NO: 54347 - DNA, 101 bp, rice(Oryza sativa)
  misc_feature (71): n=a or c
atctccctagccatcctttcaagctcggaaaaaacatcatcttccccttcctctaacccccaccctaaaanccccataatccgtacatccgttgctggaat

SEQ ID NO: 54348 - DNA, 101 bp, rice(Oryza sativa)
  misc_feature (71): n=t or c
ttagattcatatgcagaaacagatttaaattatgagtggaagccaagcacagaagagtgggatttgtatgnatcaattgagccaatacttgggtctttggc

SEQ ID NO: 54349 - DNA, 101 bp, rice(Oryza sativa)
  misc_feature (71): n=a or g
ttccatatcacaaatgtcgcttcagatgcaaggattttgtgcattgcgattactcgaattagggatgtatnaagatgtgactccagtagcatgcttgactt

SEQ ID NO: 54350 - DNA, 101 bp, rice(Oryza sativa)
  misc_feature (71): n=a or g
tcttacgaatacaacacagctttaatcagcaattcagaactaccataacaattttatcagacaaaaaagcncaggaacttttgtagagattggcattacaa

SEQ ID NO: 54351 - DNA, 101 bp, rice(Oryza sativa)
  misc_feature (71): n=t or c
attcacaaataattcttcgtttgcaattgcttcgtctgcatctgctactgcatgttgacattgtagttgtntctatggacatttttgttacagcctatgat

SEQ ID NO: 54352 - DNA, 101 bp, rice(Oryza sativa)
  misc_feature (71): n=a or g
cgaaacccacagagcagagctctctagcgaacacgaaattacgtgcgtgccctcaaaatcggcgttctctncccctttgactcgttctctctcgcgatcgg

SEQ ID NO: 54353 - DNA, 101 bp, rice(Oryza sativa)
  misc_feature (71): n=t or c
tctaacagtcttaatcaaccactgacaatatttaaaaactgaaagcatgcataaacttcacacaatatccntcagtagagacataaatatattcaatctaa

SEQ ID NO: 54354 - DNA, 101 bp, rice(Oryza sativa)
  misc_feature (71): n=a or g
atccaaccacacagactacaacaaaaatctacaagaaccatcaccaagatccaagctggcacaggctgccnacatagggcaccccagatccgtacctgaaa

SEQ ID NO: 54355 - DNA, 101 bp, rice(Oryza sativa)
  misc_feature (71): n=t or c
aaaaaaataattcaacactaattaaaccttcaagggttacacgatctttcacagactgttcctcgttcggntctgaatgaaagcttgcaatgatggttctc

SEQ ID NO: 54356 - DNA, 101 bp, rice(Oryza sativa)
  misc_feature (71): n=a or c
ttttctcctaaaccggtcaaagttagcatcataaacacagcctaatactgaccatcaggccaacctaaagnttctgccatatggcacgctaattctcatcg

SEQ ID NO: 54357 - DNA, 101 bp, rice(Oryza sativa)
  misc_feature (71): n=t or g
taatttgcacacacgaatcgacggttaatcagaaattcagaatcaagccacgaaattagggacttgtcganggctcaatcaacaacgaaatttcatagggt

SEQ ID NO: 54358 - DNA, 101 bp, rice(Oryza sativa)
  misc_feature (71): n=a or g
atgtgaacaacacagtttttatgtctataagacggtagaggtaggcattaaattatattgcacccatatcnaaccaatgtgaaaggggtggggtcagcaaa

SEQ ID NO: 54359 - DNA, 101 bp, rice(Oryza sativa)
  misc_feature (71): n=a or g
cggtgttcgctcttggattaatagccaccgtcttcttcgttcgcaagagaaagcacaagaaggtgaactcntcttccaagctcctcaagtacagcggctcc

SEQ ID NO: 54360 - DNA, 101 bp, rice(Oryza sativa)
  misc_feature (71): n=t or c
aagtttttgagaggaagattttcctggatactacaagtattctcttccatttgctgcctgcaactgaaacngggtcattgctcttaataattttgggcttg

SEQ ID NO: 54361 - DNA, 101 bp, rice(Oryza sativa)
  misc_feature (71): n=t or c
ggaaagttgtattatctacgactttccttgcggtctctcaaggggataagataggaagttgttttcccgtnaggttggaccgtagaagcacctgtccctgc

SEQ ID NO: 54362 - DNA, 101 bp, rice(Oryza sativa)
  misc_feature (71): n=t or c
ccggcgttggccactagcgggacgacgccggctgatctatagttagttaatacagtagattcagagtgtcncttttttttatacatatttgactttcttta

SEQ ID NO: 54363 - DNA, 101 bp, rice(Oryza sativa)
  misc_feature (71): n=t or c
tccgctgagttattggaggtggtttatcattctgcgatggtcatatcttctattgtgttgtgggcgacccnccccaccgtagctacatagttctccgtagg

SEQ ID NO: 54364 - DNA, 101 bp, rice(Oryza sativa)
  misc_feature (71): n=t or g
actcttcttccataacctctatcaccgtcctgtttttagcgctgccataatacttgggaggtcgagcaatncagtggatcagatcagctgctgcaacgacg

SEQ ID NO: 54365 - DNA, 101 bp, rice(Oryza sativa)
  misc_feature (71): n=a or g
tagaaggctggttgcatcctgccacaaacaacccaaagtacttaaatcttcttcagagagttggcatactncttgatgtggctaatgcgctggattatcta

SEQ ID NO: 54366 - DNA, 101 bp, rice(Oryza sativa)
  misc_feature (71): n=t or c
aaaaaatcccaacggcagaaatgtaggacggacacgtacagtacaactcaatcaataacatccactgtcgngatgctcttacaagtactcttttcgtccca

SEQ ID NO: 54367 - DNA, 101 bp, rice(Oryza sativa)
  misc_feature (71): n=a or c
tccctaggggcattctcatctatttgaaattatttttctttgcaattgacccaaaagtgtcttcctgctanttacaaaaatttgagatgtgtcctgtagta

SEQ ID NO: 54368 - DNA, 101 bp, rice(Oryza sativa)
  misc_feature (71): n=a or c
ttaatcacgtgtaaatggactgctccgttttccgtatgtacagcttgggttgagaacataggcttccgaanacaactaagttcatgactagtaagatgaga

SEQ ID NO: 54369 - DNA, 101 bp, rice(Oryza sativa)
  misc_feature (71): n=a or g
tttagagaatgaaatgcatctgtcgtgttttatgttgcaggagccagtgccacattggatcaaagcaacgntgacaacctcgcggttgtcacgtgccaacg

SEQ ID NO: 54370 - DNA, 101 bp, rice(Oryza sativa)
  misc_feature (71): n=a or g
aaatgattcggtcgcacggtggttgtgaagtcggagccatgatatgtggcatcgaaagcattagtcaaacngacttcggttttggtcaggtaaagttgtgt

SEQ ID NO: 54371 - DNA, 101 bp, rice(Oryza sativa)
  misc_feature (71): n=t or c
atacaattagcctacactttgcggaagctttgcccaagtctgggggattcgacacagtgttggtggtcatngataaatttaccaagtttgccaaattcata

SEQ ID NO: 54372 - DNA, 101 bp, rice(Oryza sativa)
  misc_feature (71): n=t or c
tgcgcaatgctcgtttacctgagaaacgctcaggagtttttcggctaactccaaaaggtagtgggctagangatttggattcgaaatctcaccccttctaa

SEQ ID NO: 54373 - DNA, 101 bp, rice(Oryza sativa)
  misc_feature (71): n=t or c
gatccgtttaatggtttctctttaaaaatcagtacattacgaacgcagatgctcacaactcacgcatattngtccatatgagcacacacgactagactaga

SEQ ID NO: 54374 - DNA, 101 bp, rice(Oryza sativa)
  misc_feature (71): n=a or g
gcagataggagagagagaggcggcgatggtttttggcgcaacaaaccccgcccgaatcggagggggaaacngttacgagggaggcggtggagactggtagg

SEQ ID NO: 54375 - DNA, 101 bp, rice(Oryza sativa)
  misc_feature (71): n=a or g
ggggggctgggcattgacacgtacgtacgttgtgttagctaatgctgatgggctcgtgatgtcgggcactncatgcatggtgcggtggtgtggagtgtgga

SEQ ID NO: 54376 - DNA, 101 bp, rice(Oryza sativa)
  misc_feature (71): n=a or c
aggaatcctccttgagcttcttctccttcctcttggtgattagcttcttcagtcacctcttcttcttcctnttggtgggatgggtcatcaaatcgccgttg

SEQ ID NO: 54377 - DNA, 101 bp, rice(Oryza sativa)
  misc_feature (71): n=t or g
ataatcttggaaactgacaacatagaggtgttcaaggctctgtcacaacaggagctgtcaagatcaccctnggcagcgacaataaaggaagcgagagggat

SEQ ID NO: 54378 - DNA, 101 bp, rice(Oryza sativa)
  misc_feature (71): n=t or c
agtattccagcagccaatgctgtcttcctcaaggtacatagactggtctggctcgaaattctctcaagtanattttggtttttttgtctaaaaatatcgaa

SEQ ID NO: 54379 - DNA, 101 bp, rice(Oryza sativa)
  misc_feature (71): n=a or g
ctcgacccaggctaaccaaatcgtataacaaaatactacggtgatgtttgaaactcacgtaaataaagatnaaaatgacgattaagggtgtgtttgaggag

SEQ ID NO: 54380 - DNA, 101 bp, rice(Oryza sativa)
  misc_feature (71): n=t or c
ataacttagcagtgaaagagtcatacaagatagttaagacaactgggataagctaggccagccgcccggcngccgcagattttgctgttgccacagcttag

SEQ ID NO: 54381 - DNA, 101 bp, rice(Oryza sativa)
  misc_feature (71): n=t or g
atacttttctgaatatttactctccatctctctctcacaaaaggagcaataagctagcacaactaaacctncaatctgctgatcgaaaaagaaaataaaga

SEQ ID NO: 54382 - DNA, 101 bp, rice(Oryza sativa)
  misc_feature (71): n=t or c
atctgccggtttgagccattctgtcctgtatgtactaaatgagagaaagaataatttctctcatacctggntttccagtcccggattttaaatttaccaca

SEQ ID NO: 54383 - DNA, 101 bp, rice(Oryza sativa)
  misc_feature (71): n=t or c
aacaaaggtttcaatggtaccagataataccacaaaatccttccacttgccagaattagcacaaaattganggagtgacgggagaatgacggagttagttt

SEQ ID NO: 54384 - DNA, 101 bp, rice(Oryza sativa)
  misc_feature (71): n=a or c
tataagctagcatatgtggagaagaaacgagcacacgtttattatcacaaaatcaattttcactggtgacnaaaatcagttttctcaggcagctggacacg

SEQ ID NO: 54385 - DNA, 101 bp, rice(Oryza sativa)
  misc_feature (71): n=t or g
caatagatatggcattttgatgatatccaatgacatgagccagtgcactgctgctattcctgaaaatttancatgtgcacaagaggacatatattcgaaat

SEQ ID NO: 54386 - DNA, 101 bp, rice(Oryza sativa)
  misc_feature (71): n=t or g
tatcaggaagcagcttcaagagatggagaggaagcaagcaaatatctttgatatgttgcaggtaattcttnttattttgtgttgttttttttattctactc

SEQ ID NO: 54387 - DNA, 101 bp, rice(Oryza sativa)
  misc_feature (71): n=a or g
ggccagaattctccacggtgagcaacggccacaagtggtcttgaatttccaaatccgtgtgataaattttntaatattgattatgtgatgtgtgatcgatt

SEQ ID NO: 54388 - DNA, 101 bp, rice(Oryza sativa)
  misc_feature (71): n=t or c
ttgtcacaaggagaaggatgtcgaataagtgtgtctaatcctgatttttggaaatccaactccttgagagngttagacctgcatggtctcttgtccgccag

SEQ ID NO: 54389 - DNA, 101 bp, rice(Oryza sativa)
  misc_feature (71): n=a or g
accggctcgccggcgacgtcgagcaagctgatcttgacgcgtgctcggacgacgacatcgtcgtcgtcgcngccggtccgcaccagagcgaaggatatcga

SEQ ID NO: 54390 - DNA, 101 bp, rice(Oryza sativa)
  misc_feature (71): n=a or g
tgtagtgatgggccgtgggccttggcgacaagcgaagctgaatgggctttgttcttttgctatctgtgganacgagtgatgcgccgatgacgtgtgcggag

SEQ ID NO: 54391 - DNA, 101 bp, rice(Oryza sativa)
  misc_feature (71): n=t or c
ttttatcctgaaatatgtagccaactacccgaattcacacaccgtgctctagtctcatctcacctctttanttattaacatcccttccttgctatcctccc

SEQ ID NO: 54392 - DNA, 101 bp, rice(Oryza sativa)
  misc_feature (71): n=t or c
aaagcaaaataaaaaagtgaattaaagctgatgttataaccctctggctcacttcacatgaacagaaacangatgttgtaaccaaatagtagtacttaggg

SEQ ID NO: 54393 - DNA, 101 bp, rice(Oryza sativa)
  misc_feature (71): n=t or c
tagctgtttatacttgccagtctttgaaaaagatcccaagtctgaatttttcatccagcatctgtccttgnaatctaagatacccttgtatgctgtatttt

SEQ ID NO: 54394 - DNA, 101 bp, rice(Oryza sativa)
  misc_feature (71): n=t or c
atgacaaaaatcaattttgtcctggttcgaataggaacgggactaagatcttaggccggattcaaaagccnaaagactttttatgatctttaatcccggtt

SEQ ID NO: 54395 - DNA, 101 bp, rice(Oryza sativa)
  misc_feature (71): n=a or c
attaactagtggaatggaattcttggtcttggagggagatggattagcttagtttgagtattttgatgatntgctgctgctgtctgcctcagctctttcct

SEQ ID NO: 54396 - DNA, 101 bp, rice(Oryza sativa)
  misc_feature (71): n=a or g
ggatgtgaattccacttccgagtcagtgacagcgttggcttctatcttcctctcttgttcacttttttttnctgcatatttaacccatattgcacgtccta

SEQ ID NO: 54397 - DNA, 101 bp, rice(Oryza sativa)
  misc_feature (71): n=t or g
ctctagctagggaggttaaaacttttcgagcccatgcttctatatatatacacaaggcaaactaatgagtnctctctaaaatttaaattgtcttaagccca

SEQ ID NO: 54398 - DNA, 101 bp, rice(Oryza sativa)
  misc_feature (71): n=a or g
ataaaaaaaattaacaaaaattgagcccgccccattttatacctagtcatccagccctcaaattttgtatnctataatgaatactactaccttcatctcat

SEQ ID NO: 54399 - DNA, 101 bp, rice(Oryza sativa)
  misc_feature (71): n=a or c
gcgtgagcaggcagacaactggctataggcaaggttacactacagtagtaaatgcaatccatccatggagnagcaacataatcaatacggttccaactgct

SEQ ID NO: 54400 - DNA, 101 bp, rice(Oryza sativa)
  misc_feature (71): n=a or g
gtaaaaaaaataaaataagggaattcatgaacctgcctaataacgctactggagaaatgatctttactagntcacacaaaaatcacattagtcccggtttg

SEQ ID NO: 54401 - DNA, 101 bp, rice(Oryza sativa)
  misc_feature (71): n=t or c
caattgagtggtgctgggttgagagtcagaccagatttttggtcctctgccagcttgaccagtttgccganggggtgagcggcgttgagcagttggagggt

SEQ ID NO: 54402 - DNA, 101 bp, rice(Oryza sativa)
  misc_feature (71): n=a or g
attatagatggtaaacaatgcccatatactggattcgcatcatctgccattaggagcaatattggcagacncgcatagtaaaatgagtctgatgctacagt

SEQ ID NO: 54403 - DNA, 101 bp, rice(Oryza sativa)
  misc_feature (71): n=t or c
aacaggcagccttgccaactcagaaaatctcgaattgttcctggcttgtggtatccaagttcactgcagcnttgccaactcagcccggaacacgtcgacgt

SEQ ID NO: 54404 - DNA, 101 bp, rice(Oryza sativa)
  misc_feature (71): n=a or g
aatgcataatatgaaactctatgatagtgttcatcagtacctgggattgttgctcgactattttgtctccntttaagcttcctgcagaactgaattagaac

SEQ ID NO: 54405 - DNA, 101 bp, rice(Oryza sativa)
  misc_feature (71): n=t or c
cagctgttgatgagctctccagttatgtagatctaggcggcgagctccaagacaatgtggatcgagacttntggtacatccctcgcatcccctctcatatg

SEQ ID NO: 54406 - DNA, 101 bp, rice(Oryza sativa)
  misc_feature (71): n=a or c
ttccgtaggtggttgtgcgcttgtgctacttgtttttttctcatctgctttgctctatcaatatattaggnagagctaatttatgttcaaaaattgaatag

SEQ ID NO: 54407 - DNA, 101 bp, rice(Oryza sativa)
  misc_feature (71): n=a or g
ccagtagctcatccggcataggcataacagttgccccccctggaattggagcttgtccccaagggacagcntccggaaatctggtgcgaacaacgtcagca

SEQ ID NO: 54408 - DNA, 101 bp, rice(Oryza sativa)
  misc_feature (71): n=t or g
cccctcctccccatcccctcctccccctaacgcgctaagcaacttagaaaaaaaactcaacaatgctaaancatgggtcagatcattaataggtagaaaga

SEQ ID NO: 54409 - DNA, 101 bp, rice(Oryza sativa)
  misc_feature (71): n=t or c
ggctcgtggttcagcggcggctactgcaacaggacgcggccattggaggaggatgaggtgagctcgggcgncattgcctgggagctgagggcggcgcagat

SEQ ID NO: 54410 - DNA, 101 bp, rice(Oryza sativa)
  misc_feature (71): n=a or g
gtcacactcattagctcacaattcacagactctacacttgaaatggtgagaatcttatagctctggctagncaaccatggctgagggcgtcattggctcgt

SEQ ID NO: 54411 - DNA, 101 bp, rice(Oryza sativa)
  misc_feature (71): n=t or c
ttagtctgaataattaaaaacacgttgcatttcacatttccggataaacaaacttacgaacagtccaggtntaaaacgttggatataaaagataatcttga

SEQ ID NO: 54412 - DNA, 101 bp, rice(Oryza sativa)
  misc_feature (71): n=t or c
tcattacttcactaaaaaggaagcggacaagccgtcaattactcatagcctaatacgcatacttacacgcnagtgaatccagcgcacgaaaacaaaacctc

SEQ ID NO: 54413 - DNA, 101 bp, rice(Oryza sativa)
  misc_feature (71): n=a or g
ctgattgatatctcccatatgtgaagaaatcatgaccttcggggatgcagtaggtaataaatagcgtatancgggttgttagcggattagtgtccgtgcag

SEQ ID NO: 54414 - DNA, 101 bp, rice(Oryza sativa)
  misc_feature (71): n=t or c
gtacgtacgctttctctcgctggtataatcagctggcgatcgatagcggcaaaaatatgttatgtgttcgngtcagtctctttggctttgtattaaaaatc

SEQ ID NO: 54415 - DNA, 101 bp, rice(Oryza sativa)
  misc_feature (71): n=a or c
tataccatttctgaccatacattatttaatgacgggtgatattttttaaccttaatagatgctaaactatntaaaataataaatattttgggacggaggaa

SEQ ID NO: 54416 - DNA, 101 bp, rice(Oryza sativa)
  misc_feature (71): n=a or g
gtcgaatcctgccaaaactgttcctctctaccacttgaagcatgctccgatggacgagttctatgagatanctttcagcaacctcctctaagctgattgat

SEQ ID NO: 54417 - DNA, 101 bp, rice(Oryza sativa)
  misc_feature (71): n=t or c
tatcaccacttgttgcctacctcactttccgtgggggcatacccacatccaatggcatctaactaacatanacaccatgcttatgttaataaataatgtca

SEQ ID NO: 54418 - DNA, 101 bp, rice(Oryza sativa)
  misc_feature (71): n=a or g
caactcacctagatctttcagtgcaaactctcctcttagatcctgaagtaatgcagcagtcgccctctctnaagaactggctacaataatgtcatcaacat

SEQ ID NO: 54419 - DNA, 101 bp, rice(Oryza sativa)
  misc_feature (71): n=a or g
accaaaaggaaggagccgagagacagccaaagcaagctaacttaaggaagaaaacatccagtcgtccaacnctaaaaataaggaagtcagccaggtatgtg

SEQ ID NO: 54420 - DNA, 101 bp, rice(Oryza sativa)
  misc_feature (71): n=t or g
gtttaaacctttttgaatccaattcttttgctaatctatgaccacgaaagaaccagagaaccctcccaaanttaccaaatgatataaaacaagtcctagta

SEQ ID NO: 54421 - DNA, 101 bp, rice(Oryza sativa)
  misc_feature (71): n=a or g
ttgttttcgctagaaaagaacacgagaagatagcgaaagcttgggggtgaaatcctgtggtgtttcatggnccaagctactcgttgaagagataatttccc

SEQ ID NO: 54422 - DNA, 101 bp, rice(Oryza sativa)
  misc_feature (71): n=a or c
cgcgctctagcctttccttcacatgctatctcgtgttggtctactccgttcgtattcactggtagagaaancatctttggtcggtcgacccaaattcacaa

SEQ ID NO: 54423 - DNA, 101 bp, rice(Oryza sativa)
  misc_feature (71): n=a or g
ctgatggcttgtgggtctttatcggttgcacaataacctttccaacattccaatgcagctccttgtaactnatgagcagcatagaatactttgttcttctc

SEQ ID NO: 54424 - DNA, 101 bp, rice(Oryza sativa)
  misc_feature (71): n=t or c
gttatgcactaactggatgcccatttttttagttagagttgaaataagagttgttgggacagggggtatcnacttttaaagagaatccaacttttagtagt

SEQ ID NO: 54425 - DNA, 101 bp, rice(Oryza sativa)
  misc_feature (71): n=a or g
tccaacaaactaaaagactcgaaaacaaagagaaggcaccaacgaatctcttggacaccgacgactcgacncctcaccaaccacgcccaaccaacgccacc

SEQ ID NO: 54426 - DNA, 101 bp, rice(Oryza sativa)
  misc_feature (71): n=t or c
aacttaacatgtgaaactagttttgactgtggcattatggatttatttaggtggttcatagacactactanagattcgatttctccatgcggccataatca

SEQ ID NO: 54427 - DNA, 101 bp, rice(Oryza sativa)
  misc_feature (71): n=t or c
atcagatggaatttaacatagttctgatgggatatccaacaaaatgggaattccatcatagtcgaaatgcntcaaccacgatgaagtaaagatgcaacaat

SEQ ID NO: 54428 - DNA, 101 bp, rice(Oryza sativa)
  misc_feature (71): n=t or c
cctgggccttggaatcttgacgtcccacgctgactcagctttgttgtccgcagtcaatctactttggttgngttcttttcttctgaagataaatattaaat

SEQ ID NO: 54429 - DNA, 101 bp, rice(Oryza sativa)
  misc_feature (71): n=a or g
cggaggaggtggcgctgggtacttgtggagggtgaggtcagtagtacacgaaagatttccctggacgtcgnccctggtagatttcaggtgggccgtaagtg

SEQ ID NO: 54430 - DNA, 101 bp, rice(Oryza sativa)
  misc_feature (71): n=a or c
ggccccaccgccggcgccgctatctcctcccacatggacattgacaaggtcagattacctacttgccattntgaatttctgaattccgattgattatgctt

SEQ ID NO: 54431 - DNA, 101 bp, rice(Oryza sativa)
  misc_feature (71): n=t or g
tcttcaaagaaataatgcagtacagtactaaatgcagtagcacgcggtagctagctagctcctgcgatgcngctcccccgaacagactgccaggtgcaacg

SEQ ID NO: 54432 - DNA, 101 bp, rice(Oryza sativa)
  misc_feature (71): n=t or c
acgaaaaaaaaaggaaaaaaaaagaaaaaaaaaaactgcggcgagccggagacgtggctccccgactcctngcgcgcgcggccggcggcgagaagggcggc

SEQ ID NO: 54433 - DNA, 101 bp, rice(Oryza sativa)
  misc_feature (71): n=t or g
aaaaagttaaatcaaattcaaataaggggatcgagtatgcatgataccaaaagaaacagagagagagaganagagagacaaatgagtagatatgcagagag

SEQ ID NO: 54434 - DNA, 101 bp, rice(Oryza sativa)
  misc_feature (71): n=t or c
taaaaaaaaaccgagcaccacctagccgcatgcgcctcgtcctccccgcctcatccttatcccctccactncaactcttcttccagtctcatcctctcatc

SEQ ID NO: 54435 - DNA, 101 bp, rice(Oryza sativa)
  misc_feature (71): n=t or c
ttaaagtttttcttctactgccacataagcatccacatatgacgaaaaccaagttaacataccacgtggangccagatcagatgaaaccatcgtgggactc

SEQ ID NO: 54436 - DNA, 101 bp, rice(Oryza sativa)
  misc_feature (71): n=a or g
gatggcctcatcaagcgacgtcgacctcgccgaccgcttcgacatgtccggcccgacgcatatgatgaagnaaaaaattattcattggtatgcagcatgct

SEQ ID NO: 54437 - DNA, 101 bp, rice(Oryza sativa)
  misc_feature (71): n=t or g
tgtcacctgagggggtacactatctgattctgctgcatctttctctacaacacacaactgaaccatccgtnatacagctcctgatttaaccaacccagaaa

SEQ ID NO: 54438 - DNA, 101 bp, rice(Oryza sativa)
  misc_feature (71): n=t or c
cgtcagtcatgtgtttccatagcataacatctggaatgatttgttattgcgagatatggtgaatggcatangtaatgtgtcatttattatgaaccgtttat

SEQ ID NO: 54439 - DNA, 101 bp, rice(Oryza sativa)
  misc_feature (71): n=t or c
ggatgaaataattccgccaagagttgatgcccatgatgattttgagggccaggaaaagtctagggatatanacactgatgaacagctcgcgcagcaagccc

SEQ ID NO: 54440 - DNA, 101 bp, rice(Oryza sativa)
  misc_feature (71): n=t or c
aaaagtagcaactataatcttcgtctgagcagcttcctctccatataaaggaattccccgcaggactctcnactgactcttgatcaccccaaaatctcttt

SEQ ID NO: 54441 - DNA, 101 bp, rice(Oryza sativa)
  misc_feature (71): n=a or c
agtctggaaacccgactaaacggtaggagtatgttcacatccttctccctcctttaccacacggtttttcnaactactaaacaatatatttttttaaaacg

SEQ ID NO: 54442 - DNA, 101 bp, rice(Oryza sativa)
  misc_feature (71): n=a or g
agggtgaaaagaggttttcttcacgcttagcagactacaagtatgtgacgatgacactagcctagtggagnaggggtttttctcccagcgtatgggcgaag

SEQ ID NO: 54443 - DNA, 101 bp, rice(Oryza sativa)
  misc_feature (71): n=t or c
ctactggaaacttatcagataatgtatctgtcatcaattcatctcatgtgggaaattcttccattggcagngtgttttattttctctttccagtaagctat

SEQ ID NO: 54444 - DNA, 101 bp, rice(Oryza sativa)
  misc_feature (71): n=t or c
acaaacaaaattacctcacccaggtggccacatatgcatataagaatgcggtccatctttcgggcatgttnactttgatgctaaaaaaaaatcttactaaa

SEQ ID NO: 54445 - DNA, 101 bp, rice(Oryza sativa)
  misc_feature (71): n=a or g
catcacaatagcatcattcaatctttaattcatttgagagttgagagtgagcggaatatatttgtattctncgattgaggagaatggccagccctggagtt

SEQ ID NO: 54446 - DNA, 101 bp, rice(Oryza sativa)
  misc_feature (71): n=t or c
aagcctaagtatctacttatagaaacttagtacccacaaactgaatagactctcaccatatacccagtgcngtcaggaggatgttgaattggggtatattt

SEQ ID NO: 54447 - DNA, 101 bp, rice(Oryza sativa)
  misc_feature (71): n=t or c
taaggttgttatcattaacccggcaaaacttaatctcatgcgtgtatatatatctctgtactcctgtcgcnggtttgtgcgaatccaatcaacacgaaagc

SEQ ID NO: 54448 - DNA, 101 bp, rice(Oryza sativa)
  misc_feature (71): n=a or g
agttacgcactctattataattgagaaccaaactttatatctctcgatgttttataggtttgtttattttnggacggaagaaatatgaccgatcgacgtga

SEQ ID NO: 54449 - DNA, 101 bp, rice(Oryza sativa)
  misc_feature (71): n=t or c
ttacaaatcatgtattatttttttccatttttcttctttatggatagagggaaggataagtgggatgttancggggtttataaaaccgccggtaaccacac

SEQ ID NO: 54450 - DNA, 101 bp, rice(Oryza sativa)
  misc_feature (71): n=t or g
gcatggatgaaatttgagatgggtgcaatgcctagtctaaggaagctcaagctaggttttgatgtccatanagcagatcagcatgatattattcctgttgg

SEQ ID NO: 54451 - DNA, 101 bp, rice(Oryza sativa)
  misc_feature (71): n=a or g
gctcaccatcctccacggggtgctcatccacctcctccatgccatcgacagggtccgattcctcctattcnccttcctctcccgtgccctcgcctctgccc

SEQ ID NO: 54452 - DNA, 101 bp, rice(Oryza sativa)
  misc_feature (71): n=t or c
tgcagggactctgcaagtcagagaatgagaatgaatgaggtagtgaaagaattgagtggcataaaggaggnatgcgaatctaaattcgaggaattttatct

SEQ ID NO: 54453 - DNA, 101 bp, rice(Oryza sativa)
  misc_feature (71): n=t or g
ctcatcaatcaatcaaggtgctccctctcgcttcgtctcccgtgaattacatcaagcgaaaaatattgcantgagttgcaccaacaaaatctaatcatcgc

SEQ ID NO: 54454 - DNA, 101 bp, rice(Oryza sativa)
  misc_feature (71): n=a or c
cttaattaatcttctgttgcttctctaaaacctggtcaattttcaattcaatcgtccatttcacatggaanatttgactacatgtaaatctagttttcatt

SEQ ID NO: 54455 - DNA, 101 bp, rice(Oryza sativa)
  misc_feature (71): n=a or g
ttttttctagcttcgggaatagggatgataattttgccaatggatccgggtatctgcggatacccagcccnatgggtatagatgtgggtgtgattttttac

SEQ ID NO: 54456 - DNA, 101 bp, rice(Oryza sativa)
  misc_feature (71): n=t or g
gatcagatgcaacagagaagattctccactgaacactcgatctcagccgcccaaaagggaattgtaaaacngcagataccttgataactttcgaagcaccg

SEQ ID NO: 54457 - DNA, 101 bp, rice(Oryza sativa)
  misc_feature (71): n=a or g
aaagatttattttttaacgaaaatggaaaactattttggcaatacttgaaaaaatatgtacataacaggcnaaaacaaattagccctagctctatctatgt

SEQ ID NO: 54458 - DNA, 101 bp, rice(Oryza sativa)
  misc_feature (71): n=a or c
tgcagcggtccatgaggttgatggtgtagaagcatatagcttggtgaagagcgccaggctaagccacctgncctgcgagggtagatcagcgatcgacgcgc

SEQ ID NO: 54459 - DNA, 101 bp, rice(Oryza sativa)
  misc_feature (71): n=a or c
agcagcagctaagatagtttcgtgatcgagcttggtgtatatagcaaccaagtggcagaagaagaagaagnagcagcaagaagaagaagaggaagaggtgt

SEQ ID NO: 54460 - DNA, 101 bp, rice(Oryza sativa)
  misc_feature (71): n=t or c
aggataagtagaaaataataggaagataaggggttgtgcaacaaagaagggaatatttaaccatttgccanatttagatgtggcaattaactttttgccac

SEQ ID NO: 54461 - DNA, 101 bp, rice(Oryza sativa)
  misc_feature (71): n=t or c
cagcgccaattagagtggcgctcagacgttttagctcagcgccgagacgttttagctcagcgcctgacggnctattcttgaaattagtttttgacacggtc

SEQ ID NO: 54462 - DNA, 101 bp, rice(Oryza sativa)
  misc_feature (71): n=t or c
attctctccacaacaataaatgaagagtgaagccatgacgtacgatccaaattcccatgtgttatccttgncagtactaattggaatttggcaaattccca

SEQ ID NO: 54463 - DNA, 101 bp, rice(Oryza sativa)
  misc_feature (71): n=t or c
actggtaatgtgattttacccaatggcttagatgatgattctggagtgatcccatcgaagggttgataggnatcaactcgcttcgtggaatcgccattgca

SEQ ID NO: 54464 - DNA, 101 bp, rice(Oryza sativa)
  misc_feature (71): n=t or c
atcaaaagaggactgtggtcagagtaaattctctctaagacccttccacatgccaaagggaattaatctcncatttatcattaaaaagaattctgtccaat

SEQ ID NO: 54465 - DNA, 101 bp, rice(Oryza sativa)
  misc_feature (71): n=t or c
cacgcattccagagagtgtcaggatggctagatgcgatcttccttgcggccttcacggagcgaacatatcnagcatgctagttagggcacccacaatggtt

SEQ ID NO: 54466 - DNA, 101 bp, rice(Oryza sativa)
  misc_feature (71): n=t or c
ttcagcagttctcttctgtaaaatttctgcctgaagctgcttcctaaggtcctcctttggtgtcctgctgngggatcgcaggttttctttcaacggcagca

SEQ ID NO: 54467 - DNA, 101 bp, rice(Oryza sativa)
  misc_feature (71): n=t or c
tgaaggggtgttggttgcaacttgcaagtcaccggccagcattgccccctattttgccgggaaaattgtcngggaacaacctgacctctcatttcccgcca

SEQ ID NO: 54468 - DNA, 101 bp, rice(Oryza sativa)
  misc_feature (71): n=a or c
ggccggacactttatttactcattcattcagacgccatgggacaattccaaggaccgaaccaatgttgtgntccggtctaaccagaatacattacattggc

SEQ ID NO: 54469 - DNA, 101 bp, rice(Oryza sativa)
  misc_feature (71): n=a or c
cccttggtataagcaagcaccttcagttacctcatccaagaaattaaatgttctttccttgcagagaccanacacacacacacacacacacagatatatat

SEQ ID NO: 54470 - DNA, 101 bp, rice(Oryza sativa)
  misc_feature (71): n=t or c
cgtcgccgcacaaagaagtacaagttccatctttttcagatgctcctagaggttctccacatgtaggttgngaccagggaggtttgggattgcctcaagaa

SEQ ID NO: 54471 - DNA, 101 bp, rice(Oryza sativa)
  misc_feature (71): n=t or c
gcagtccagagtcagcgttcttgaggttcgagcgaagtttttctagggcttacctaaacccaatccttccnagaagagtagtatcggtagtcgttagatcg

SEQ ID NO: 54472 - DNA, 101 bp, rice(Oryza sativa)
  misc_feature (71): n=a or g
attgaaacaaaacggtagatctcaagataccgtctttttgggaaggagaaactgtgagataaaattggttntgtagcagtatatcgccgaaatttagtgat

SEQ ID NO: 54473 - DNA, 101 bp, rice(Oryza sativa)
  misc_feature (71): n=t or g
tttgtagttaacggatacaagagggagaggggcgacaaaagcggatgcagaggtgaggagggtgagggcangtttagcagtccactctgggatcttttctg

SEQ ID NO: 54474 - DNA, 101 bp, rice(Oryza sativa)
  misc_feature (71): n=t or c
gacctgtgtcaagctgttgacattattgaaagtgcatatgcatgccatcttagtatacctcacggtagttnttgttttttttaataatgaaatagatatat

SEQ ID NO: 54475 - DNA, 101 bp, rice(Oryza sativa)
  misc_feature (71): n=a or g
ctaatcaaacagcaccattaatacttgattcctctctcatatacatataatactcttaagcatccgtaatngtaaagtaaggtgttatctataaaatatgt

SEQ ID NO: 54476 - DNA, 101 bp, rice(Oryza sativa)
  misc_feature (71): n=a or g
cttccaaatttgattccgcttttcaaacgcacacaatctctcttatatgccatcaaatcttcataaccacnttcattgttctttagtcaaagcatcacgca

SEQ ID NO: 54477 - DNA, 101 bp, rice(Oryza sativa)
  misc_feature (71): n=t or c
atcaccattaccagatctattaacggtgtcagcattatccaacctcccggaaaacttatctggatttgttntataaaagctttcaatttcatcatgaacca

SEQ ID NO: 54478 - DNA, 101 bp, rice(Oryza sativa)
  misc_feature (71): n=a or g
taacatccatatagctagattgagggtgcattcgtcatatattatccgctactatgagatcatcacgggtnctatctccgtcccaaaataagtgtagccat

SEQ ID NO: 54479 - DNA, 101 bp, rice(Oryza sativa)
  misc_feature (71): n=a or g
agttttctttcaaaagaaattgtcattggccatataggatatagattttctataaattaatgtgtcgttanttttttttcaaaagaaattgtcatttgcca

SEQ ID NO: 54480 - DNA, 101 bp, rice(Oryza sativa)
  misc_feature (71): n=t or c
atcagccagaaaatgaagaatgttgtcatcaccaagtcctcgccggagctcgtcggcctgtcgaccaagcnggcgccgccgccgcccggtgacatcagcct

SEQ ID NO: 54481 - DNA, 101 bp, rice(Oryza sativa)
  misc_feature (71): n=a or g
catcaattacaataagatacctacaaatagattctttttgtcatgatcttttgggcactcaagtttgttcnattggaagtttggaacatctattaattggc

SEQ ID NO: 54482 - DNA, 101 bp, rice(Oryza sativa)
  misc_feature (71): n=t or g
atcgaataacgccacacacatataagctagtctaaatggagaaactttaacgtggaaaatagtaaacccangcttaggcctaatagattttgagtgctcca

SEQ ID NO: 54483 - DNA, 101 bp, rice(Oryza sativa)
  misc_feature (71): n=t or c
accgtagaagcgagactgtgccttgcaacagaactattggaatacaaaggagcacagttgttaagatggcnggcaagctccttggtgctcggagagtattc

SEQ ID NO: 54484 - DNA, 101 bp, rice(Oryza sativa)
  misc_feature (71): n=t or c
gctgaggaagatggcgggtatctagaatcaagaagacaagaacctggggctttccgtcacggcagccgcgngcagcgagaccacagtcaccacagatatgg

SEQ ID NO: 54485 - DNA, 101 bp, rice(Oryza sativa)
  misc_feature (71): n=a or g
aatattttccgttggttcaattaactaccctattgtaatgttacaattttaagggaaataaaagtcacctnatgttttctttaatgccaaaattttacggt

SEQ ID NO: 54486 - DNA, 101 bp, rice(Oryza sativa)
  misc_feature (71): n=t or c
ccaattgacggtggaaatgctacggtacagactacatagctcactctacgacggaaagcctactttctgantctcaccgtgcatacacagtcctctgcaca

SEQ ID NO: 54487 - DNA, 101 bp, rice(Oryza sativa)
  misc_feature (71): n=a or c
ccgtggtggggtccctccttgaacaacgggccagcttttctctccgcgactccaacctggccccaggaatnggtagcatctcttcaaaaacaatgctcgat

SEQ ID NO: 54488 - DNA, 101 bp, rice(Oryza sativa)
  misc_feature (71): n=a or c
gtttctgcaaagaactaaaaagtgtgaggaactctggaacttttcctgacaatctgttacgagagagatcnaactccttgatgctttttaagttcatgaaa

SEQ ID NO: 54489 - DNA, 101 bp, rice(Oryza sativa)
  misc_feature (71): n=a or g
cttctaaaaatcagacaaaagtctattttagcccccttcaatagatatatggattgggtagtggtttttancccccttcaatagatatatggattgggtag

SEQ ID NO: 54490 - DNA, 101 bp, rice(Oryza sativa)
  misc_feature (71): n=t or c
ttcgccatactccacctccttccgacgcctcggcttctcctcctccgctctgcttcggcaggcactactanagatatggtttttccatacggctgagaacc

SEQ ID NO: 54491 - DNA, 101 bp, rice(Oryza sativa)
  misc_feature (71): n=t or g
tttgggtactttcaccccatcattggtgaatctaaccaagacaccttgtgctagctgttagcagaatttanctgtaggtggtttgaacattctgcattgat

SEQ ID NO: 54492 - DNA, 101 bp, rice(Oryza sativa)
  misc_feature (71): n=t or c
tgagacatccttttgaatatcactggagaaactactgctgcgcctaatcaaaccttttgcaccgaaggaangctttgatcccccagaacttctacctgaat

SEQ ID NO: 54493 - DNA, 101 bp, rice(Oryza sativa)
  misc_feature (71): n=a or g
acaatgacattttaacaaaatatctcggcagaagcctttgaggctttgagcaaaaaaactgataatatctnaaagtcgacgtttccatgttttccttgcag

SEQ ID NO: 54494 - DNA, 101 bp, rice(Oryza sativa)
  misc_feature (71): n=a or g
gggttcgtaacagtcacctccgtaaagacgacggacagcatggacggagaagatgttgcctccaggcccgnccctggggcagggcgatggcactgggcccc

SEQ ID NO: 54495 - DNA, 101 bp, rice(Oryza sativa)
  misc_feature (71): n=t or g
tcttcaagcatgccccggtagaacctcccaaacttggcggtgtcactcttcttcgcgtcaccaaagttgtnaactgggccagcggtgaagaagaacccgaa

SEQ ID NO: 54496 - DNA, 101 bp, rice(Oryza sativa)
  misc_feature (71): n=a or g
gctgctccatttttcttgcgggaagaaaatgtttctaaccttttcaaaagaacaaaaccttaagcaaagcnagcctaactcaactgattagattccttgtg

SEQ ID NO: 54497 - DNA, 101 bp, rice(Oryza sativa)
  misc_feature (71): n=t or c
aggaggtggtgcacatgcacatcgcggcaggagatgggcgaggagtagagcttgcgtggtcggagggagcngaatagccgcagggcaccagcgacgaggac

SEQ ID NO: 54498 - DNA, 101 bp, rice(Oryza sativa)
  misc_feature (71): n=a or g
tgggacaaggaaaaaagaagaaaaaaaaaacaagtaacaagaaagaaaaggttagctgctgaagagaaacnctcctatcgtgagggagggtggggtgggga

SEQ ID NO: 54499 - DNA, 101 bp, rice(Oryza sativa)
  misc_feature (71): n=a or g
cagggtcagcccatttatccaatgatgagaaagctcacaaacctattcaagggcatcgccttcatttcacnagagggtttatataacttgaagaaatagca

SEQ ID NO: 54500 - DNA, 101 bp, rice(Oryza sativa)
  misc_feature (71): n=a or g
gagagtgtatgtggctctcccaatccactcccctcccagatctggttaaatatacgggagctcgagaaggncgcggcgcggcaaaggggtaggtggcgttg

SEQ ID NO: 54501 - DNA, 101 bp, rice(Oryza sativa)
  misc_feature (71): n=t or c
tccaccggtatccctcttccgattctcttataccctccacatcgccaccatcagcaggtgcgagctccagnacaccaccgtccatgagcttcgcttcctgc

SEQ ID NO: 54502 - DNA, 101 bp, rice(Oryza sativa)
  misc_feature (71): n=a or g
tgcttgctagcagagtaagccatatgtagcggctcacatcatcgactagtagcaagaagtagtggttcccncccagcatcgccggcaagatcggcccacag

SEQ ID NO: 54503 - DNA, 101 bp, rice(Oryza sativa)
  misc_feature (71): n=a or g
ctactggctttctagagtgtctaatcccaagaatttacgtaggctaatgagtatggaaggccctagctctngagcttgccagtcacatatcaatcatttga

SEQ ID NO: 54504 - DNA, 101 bp, rice(Oryza sativa)
  misc_feature (71): n=t or g
ggtcactcgtgttggaagttgcagtgcagccaccatgagagagacccttgtcttatttatttttctttttnaagaaaaacattataaacacagacgttcac

SEQ ID NO: 54505 - DNA, 101 bp, rice(Oryza sativa)
  misc_feature (71): n=t or g
tagacaggagaagcttctagaaccttccagaaggtagctagctaatcgatcgatcgatcaatggcggaganggtggcgaggctggcgtcggagagggcggt

SEQ ID NO: 54506 - DNA, 101 bp, rice(Oryza sativa)
  misc_feature (71): n=a or g
cgccaaatacggatcatgtacagatgtgggctagtaagcaccacgcaggcccaaacaaagtcgtgacgatnggccgatcgaatcaatctgggccgcaaagg

SEQ ID NO: 54507 - DNA, 101 bp, rice(Oryza sativa)
  misc_feature (71): n=a or g
gcacgaaagatggacccatcgaatcactagtaggagaggctgactcgcaagttgccattcagaaagacttngtcttacagacggaagatgaggatactgag

SEQ ID NO: 54508 - DNA, 101 bp, rice(Oryza sativa)
  misc_feature (71): n=t or g
aattccttgaaatcaatgatttcttcgacccagaagatttagaacagattttgggcagtacaagaagtcanaacttgattcctgctgatgatggagtgttt

SEQ ID NO: 54509 - DNA, 101 bp, rice(Oryza sativa)
  misc_feature (71): n=t or c
tgcatcggtcaccacgcggtttggctgtactcgtggcactgttaacgtcaaattgatcctccctttatttnaggttataaaatgttttgactttggtcaaa

SEQ ID NO: 54510 - DNA, 101 bp, rice(Oryza sativa)
  misc_feature (71): n=a or g
ataaccagatttgtggcacacggatgttggacagttggagtgctgttttaggagtctctgaaaagtgaccnagaatctggcccttgggttaatgacaaatt

SEQ ID NO: 54511 - DNA, 101 bp, rice(Oryza sativa)
  misc_feature (71): n=a or g
gcttcatacggagtgcgatttcccatcgccttggttggcggccagttgagaattgaaggtacactgtgtgncgcactgcctccccccaaagccagcctgac

SEQ ID NO: 54512 - DNA, 101 bp, rice(Oryza sativa)
  misc_feature (71): n=t or c
ggagaaacacacggatgaatcacaagatgctgctaagggcttgtttaatagagctacaacagaaacacatncaggggtcttccaactagctctataagatg

SEQ ID NO: 54513 - DNA, 101 bp, rice(Oryza sativa)
  misc_feature (71): n=a or c
tggatgattggggcagaaacgggtgcctttttgaggatttcaaaggaattaaggcactcgtcgttaaactnaaagggcacatccttaactaacaggttggt

SEQ ID NO: 54514 - DNA, 101 bp, rice(Oryza sativa)
  misc_feature (71): n=a or g
tatttttctttctcatctcatcacacttggagtttgccaatagaatacaaaaacagcaggtgaggagagangagagaaaaaaaaacagagctttctctctc

SEQ ID NO: 54515 - DNA, 101 bp, rice(Oryza sativa)
  misc_feature (71): n=t or c
ttttcttttttttttaaccttgatggaaggaacgttgaatgatttgttggtttttgcgtcatggaatgaantttgtgcattaactgattagctaagttact

SEQ ID NO: 54516 - DNA, 101 bp, rice(Oryza sativa)
  misc_feature (71): n=a or g
tgattcaaatttgaaatgaaggcatcatgcatgtgttgatgtactacccctacatggctataacgtgcttnccatgcacgtatgcagttagctatagctta

SEQ ID NO: 54517 - DNA, 101 bp, rice(Oryza sativa)
  misc_feature (71): n=a or g
gctagggcatcgctaccgaggtatacaaaccagataaaggatctgaggtaggatcggataggaaacttatnccgggaggctgtaatgaaaaggaagtactg

SEQ ID NO: 54518 - DNA, 101 bp, rice(Oryza sativa)
  misc_feature (71): n=t or c
ctccatcttcagcttaagaacaagcttgttcggatgttcagcaatccggttccgcagatcttccttgagcntgtcatcactggaaccatgctcgtccttgt

SEQ ID NO: 54519 - DNA, 101 bp, rice(Oryza sativa)
  misc_feature (71): n=t or c
accgtgtgcaacactaaaaggagtcagaaaaaagtcatcggaatacaatgatgcactggtggagaaccatntttcgtcggtcaggctaattccataatagt

SEQ ID NO: 54520 - DNA, 101 bp, rice(Oryza sativa)
  misc_feature (71): n=a or g
cggttgttggaggaatgtcatgagggcctttggttaacctgccgaaactacctaatccatcaaagcatcgnctaagtcctttgggcgaagccgtagggcga

SEQ ID NO: 54521 - DNA, 101 bp, rice(Oryza sativa)
  misc_feature (71): n=t or c
tgttcctctcatggtggcgctccaccgtcatcgtctccagctcgacggagaagagccacgtcttctccacngacggcgtcaggagcacgtacgccgcgtcc

SEQ ID NO: 54522 - DNA, 101 bp, rice(Oryza sativa)
  misc_feature (71): n=t or c
taagtatgatcaaatcaataattaaggatagacatggccatttaattttgttctaccccaatatctcactnccgaccgcacacgtgactgcttgggttagt

SEQ ID NO: 54523 - DNA, 101 bp, rice(Oryza sativa)
  misc_feature (71): n=a or g
accatactggttggggccattactagtgatacctcccgcatagatctcatcacgatatatttccacgaacntaaggaggtcaaagttgtcgtatttttggc

SEQ ID NO: 54524 - DNA, 101 bp, rice(Oryza sativa)
  misc_feature (71): n=t or g
agatccggccttgtctatggcttttttggcagtagtactaatcaacttgaccaagacctctgtaaagatgntttacaggtgtgtatgtatatatgtacaaa

SEQ ID NO: 54525 - DNA, 101 bp, rice(Oryza sativa)
  misc_feature (71): n=t or c
ctacatcaacagtagctaaatttaagttggcatgtagcagctagcactcaccacaagtatagctttgatgntgtccctggtgaagccatactcttcctgat

SEQ ID NO: 54526 - DNA, 101 bp, rice(Oryza sativa)
  misc_feature (71): n=t or c
ccccttgggttgaagccctccctgtttgagatctcattttcctttcttcaatccttatggatattcttatngttggcagtataagatattacaatttgaaa

SEQ ID NO: 54527 - DNA, 101 bp, rice(Oryza sativa)
  misc_feature (71): n=t or c
cggcattgtccaacgtaattttcagtggaacatttggaatatgagccatctgcgaggagcaagtctgacanatcagaaagcaatatttgcaaacccaaaag

SEQ ID NO: 54528 - DNA, 101 bp, rice(Oryza sativa)
  misc_feature (71): n=a or c
cattggcattgttaactctggaatgcaacagcaacaaatgtttcctgttcgatccatccaccaagcagacncgtggagcaaccgacatggccgccttcttc

SEQ ID NO: 54529 - DNA, 101 bp, rice(Oryza sativa)
  misc_feature (71): n=t or c
tggtgctccgctgcgtggctgcgtgcacctggtcttggagactcttacatggacccgtctgacaggtgggncctcgatgcattcggcccaatggaacccag

SEQ ID NO: 54530 - DNA, 101 bp, rice(Oryza sativa)
  misc_feature (71): n=t or c
ctctattaaatatgtacgtaagagagaacacatgaaactcttctaagatcacttttagtgtatatgagaangatttgacatcattttgaggagttttggtt

SEQ ID NO: 54531 - DNA, 101 bp, rice(Oryza sativa)
  misc_feature (71): n=t or c
cgagcagagcaatataatttatattcatgttttaagaatctagcaaggtattcactggtggagaaaccctnattagtcccggttcgtaacccccgttagtc

SEQ ID NO: 54532 - DNA, 101 bp, rice(Oryza sativa)
  misc_feature (71): n=a or g
aagagcatccagcacttcttcaggacggcataattgcaaatattcatctgcagaatgacaatgtgaacagntgaaatttcgtgagtcccaacaaagtgcta

SEQ ID NO: 54533 - DNA, 101 bp, rice(Oryza sativa)
  misc_feature (71): n=t or c
caagtagctgcaataaggttgacgactcatatgagggtagcaactcacaaacgcaacaaactcctgcatgnctgaaacaatgttttctaggtgaccaagca

SEQ ID NO: 54534 - DNA, 101 bp, rice(Oryza sativa)
  misc_feature (71): n=t or c
ttttggatggagagagtactaatcgtattaattgatcaacaggctaggccagccaaacaaaaatatagtantaatattttgctttattatttgattgattg

SEQ ID NO: 54535 - DNA, 101 bp, rice(Oryza sativa)
  misc_feature (71): n=a or c
ttcgttagcagttggttctggcactacttctgcaacacctgcttcagcatcttcaccaattttttgcaacngtttaactagcacaaatgctccaccttttg

SEQ ID NO: 54536 - DNA, 101 bp, rice(Oryza sativa)
  misc_feature (71): n=t or c
cttccagccctttcttccccttcaggatttggatcttgcggcttgtcatcttcattcccatctcgtactcnctccatcccaaaatataagcatttttagca

SEQ ID NO: 54537 - DNA, 101 bp, rice(Oryza sativa)
  misc_feature (71): n=t or c
tgcctaggcaaggacatggcgttagtgcagctcaaggtcgtggcggctactgtggtgaagaacttcgagancgaggccgtgccaggacatatcgtggagcc

SEQ ID NO: 54538 - DNA, 101 bp, rice(Oryza sativa)
  misc_feature (71): n=t or c
ggcgccgactccgtgtgctggtggtgcgccgccctatgcttccccttccccttcttcttcttggacgacancgcaggcggccttggcgggagcgatggcgg

SEQ ID NO: 54539 - DNA, 101 bp, rice(Oryza sativa)
  misc_feature (71): n=t or g
ttcgactatatgtcacatgtaattttaatatgagtaaaatacataaccggtctttaaacttgaacggagangtcatatagacactacaagaaaaagcattt

SEQ ID NO: 54540 - DNA, 101 bp, rice(Oryza sativa)
  misc_feature (71): n=t or g
tgcgccgcctcaacatcactgtgtgtgcaggaacaagaacttaattaccggtggccatggtgacgtgttancatgagcatggcgagcccagacacgagcat

SEQ ID NO: 54541 - DNA, 101 bp, rice(Oryza sativa)
  misc_feature (71): n=a or g
tttaattactttcaacatggagcactcgcttcatgttgaaagtaaatgtcgttttggaggacacggtctcnaagaaataattctaatcagtattttttact

SEQ ID NO: 54542 - DNA, 101 bp, rice(Oryza sativa)
  misc_feature (71): n=a or c
acaagtcgtaaacctaattatacaagacatagacctacgcgaattagctctcaaaccgccttgattttctnccccatccttcttcccccgaagttgtaatc

SEQ ID NO: 54543 - DNA, 101 bp, rice(Oryza sativa)
  misc_feature (71): n=t or c
gtttaactttaatggtgctattccattaatggctagaagtggtggtatgtttacaatatttagaatggatntttagaaatatatgagaaatgaaacctaaa

SEQ ID NO: 54544 - DNA, 101 bp, rice(Oryza sativa)
  misc_feature (71): n=a or g
aacacatcaagaacattactcaagaacacataactgtctcctcgccccacgcgccttctccattattgccnttgccgtcggatggagaggaggagggtgcc

SEQ ID NO: 54545 - DNA, 101 bp, rice(Oryza sativa)
  misc_feature (71): n=a or g
catcaagccatcaaatggaaaaaggaaaagaaaataaaattagaggttgcattgggcccctatgtgctacntaatgaaagaccaataataatccccgagaa

SEQ ID NO: 54546 - DNA, 101 bp, rice(Oryza sativa)
  misc_feature (71): n=a or g
ttattggaaaaaagatgtttgtctaggcatagtaactgagctcggttacttaagcgtgcggcctaataacngaagaaatactagttcattagtgtctctct

SEQ ID NO: 54547 - DNA, 101 bp, rice(Oryza sativa)
  misc_feature (71): n=a or g
gctctcatgtggtgcactttgccggtgtggctgatcttggtcatcatgatgttcatcagcctgccactctnagtcacatatgagatatactgcatctgagg

SEQ ID NO: 54548 - DNA, 101 bp, rice(Oryza sativa)
  misc_feature (71): n=t or c
ccggcgccgagttccgggagaagctcctcctcaacatcactaagccctacatcaccttcaagtccgacccngccaacccggcggtgatcgcctggaacgac

SEQ ID NO: 54549 - DNA, 101 bp, rice(Oryza sativa)
  misc_feature (71): n=t or g
gtcgagagggcgtgggagcttgcaggccaaaaactcaagaacgtgtacgttgtcggtgtcatgattatttnggtgcgcgaagccttggaaatcgtctacca

SEQ ID NO: 54550 - DNA, 101 bp, rice(Oryza sativa)
  misc_feature (71): n=a or c
agttatttatttgtttcatataagtgaaattcaagttgttggtacatttgtaatttgcacctgcacagccnaaactacatatgaataattgatgggcttaa

SEQ ID NO: 54551 - DNA, 101 bp, rice(Oryza sativa)
  misc_feature (71): n=t or c
gagtgcaaattaagctagtgatcgatagtggtcatgggtgttggtcctcattgtactactagtctgctaanaatactggccgtcgtcatcacgtcgtcttt

SEQ ID NO: 54552 - DNA, 101 bp, rice(Oryza sativa)
  misc_feature (71): n=a or c
caacccctgtgaacgtcggtaagaaccgagatgagacgtcgtaaattagtcttgtaaaggttgtcttgttnctgtccgcgtgccatgtgatgttgagggtg

SEQ ID NO: 54553 - DNA, 101 bp, rice(Oryza sativa)
  misc_feature (71): n=a or g
tggagaaaagaaataaaaattgctagcaaaaacagagcaagttcatgccgaaaagggtagtttaccttganagtgttggagtagctcacgcccagccaggc

SEQ ID NO: 54554 - DNA, 101 bp, rice(Oryza sativa)
  misc_feature (71): n=t or c
tctttttccccaacattacaagaagcaatagcacataattaaaagttttctttatactggtctgtgctcgnagtagaatcaatctaggtcgttcatttttt

SEQ ID NO: 54555 - DNA, 101 bp, rice(Oryza sativa)
  misc_feature (71): n=t or c
ttgtaagatattaatataaaactgttctttcagtccttaatccctcttggcttccattaattaacctctcntatatattctcaaatatctgcatctccttt

SEQ ID NO: 54556 - DNA, 101 bp, rice(Oryza sativa)
  misc_feature (71): n=a or g
gggagttttggtatgatggacagaccagctgaaataccggagcaccttaatatagtggaagtcaaatgcgnagaggtcaatgagaatgtctccaaagttct

SEQ ID NO: 54557 - DNA, 101 bp, rice(Oryza sativa)
  misc_feature (71): n=t or c
aaacatcgatcgatgacaagaaacatgatcaagagaaggagagatataatgggaaactattttaatttctnaaggggatatcctctcgttttgtgcatgtc

SEQ ID NO: 54558 - DNA, 101 bp, rice(Oryza sativa)
  misc_feature (71): n=a or g
gagatcccaagctgccacacgagttcccaaccaagagacacacgatgaagtgttcaagggtaggaatttcntggtagtagaagaatccgttgataatgagt

SEQ ID NO: 54559 - DNA, 101 bp, rice(Oryza sativa)
  misc_feature (71): n=a or g
aaaccatattctagagtcctttggaaatccatcatagaagttgccgaaccaatccttaaagagttcagccnataacttggatccggcgtatgtagatgctg

SEQ ID NO: 54560 - DNA, 101 bp, rice(Oryza sativa)
  misc_feature (71): n=a or g
tttttatgaagaaaatatagattatttatacactaagaagaaaatataggggcggggtttgcgtgcgtgcnttcgtaggggtgactgtgtgtgcgttgtat

SEQ ID NO: 54561 - DNA, 101 bp, rice(Oryza sativa)
  misc_feature (71): n=a or g
aaataaatattagggaagaatctaatatcaaataaaaggctggctagcccaccgccttgtggaattacccngaagacatcttgatgtttctcacatgtata

SEQ ID NO: 54562 - DNA, 101 bp, rice(Oryza sativa)
  misc_feature (71): n=a or c
cctgtttcaggcaaaagagcgatgggttcggatggttgccgatgagactagtggtgaaagctcatgttacnttgttgaggcgtcacgtcatctagctagca

SEQ ID NO: 54563 - DNA, 101 bp, rice(Oryza sativa)
  misc_feature (71): n=t or c
tcgaaacatattattgggaagtgatttttgatgtcattgagctgacgaggtcattaaggttgtattcttcncccttcttccccaactcactcctctcattt

SEQ ID NO: 54564 - DNA, 101 bp, rice(Oryza sativa)
  misc_feature (71): n=a or c
cagcactccaggagcaacagtcattcttttcccaaacagacccctactactcgttatttctgcttcatatntaatcagatccgggatcgcatgcctcatgt

SEQ ID NO: 54565 - DNA, 101 bp, rice(Oryza sativa)
  misc_feature (71): n=a or g
tttctgtgaccactagatgacagtctaattccatccttgaaaaggttagtttgttgaagccacctcagagngatagattgcatgatttgggttttgattgg

SEQ ID NO: 54566 - DNA, 101 bp, rice(Oryza sativa)
  misc_feature (71): n=t or c
gaaagcttgtctttctgtgacgataaaggagaaatcgccaaggcaaaaagaccttgggattttgtatcagnaggccacaaaataggaaagccttcacctct

SEQ ID NO: 54567 - DNA, 101 bp, rice(Oryza sativa)
  misc_feature (71): n=a or c
cggcggccatgtactccttcaagaaccactccaccatcaccctcggcgcgcccgtcaccaccaccttcctnctcgccggcagccagaggcggctgtacacc

SEQ ID NO: 54568 - DNA, 101 bp, rice(Oryza sativa)
  misc_feature (71): n=t or g
ccgacggtttcctctaccgataatgcaggaggatttctcggtagttaattggggttttgagttggggattnttttagttttgggatccctcgaaggctcga

SEQ ID NO: 54569 - DNA, 101 bp, rice(Oryza sativa)
  misc_feature (71): n=a or g
aaattgtgatctcgcttcctttgtgggctgggcttttcatttctatctaattttgcagatccatatacgcntatgtactgtatttccctcttgcaaattaa

SEQ ID NO: 54570 - DNA, 101 bp, rice(Oryza sativa)
  misc_feature (71): n=t or c
agggcgttggaggcaacgaccagcagtggagctcaatgttgcttagggaggtcggcggagcaagaggttgngtggaggcagctgcagtggcggcggagacg

SEQ ID NO: 54571 - DNA, 101 bp, rice(Oryza sativa)
  misc_feature (71): n=t or c
gatgttccaatggtagagaaggccatagatgccatttgccagagtaagggatcacgagatgagaatgtcgnaataaccaaaggttaaccattaaacaatct

SEQ ID NO: 54572 - DNA, 101 bp, rice(Oryza sativa)
  misc_feature (71): n=a or g
gttggtctctaccatcatacagtgctcgaacttactagcaagcagaagaataaaagcaactatgacccccngatttttcttgacatcttgaaggagtgtga

SEQ ID NO: 54573 - DNA, 101 bp, rice(Oryza sativa)
  misc_feature (71): n=t or g
tgcgaagggggattgggaggtcagctgtcaagatgtttccctcgcgctttgtgcctggcgcaagcagttcnggcaaaaggatggccgatccactaccaagg

SEQ ID NO: 54574 - DNA, 101 bp, rice(Oryza sativa)
  misc_feature (71): n=a or g
cttttatgcaggagttacttgcatttctattggatggtctgcatgaagatctcaaccgtgtgaaaaagaanccatatattgaagcaaaggatgccgatggc

SEQ ID NO: 54575 - DNA, 101 bp, rice(Oryza sativa)
  misc_feature (71): n=t or c
cgaatttcacgcagtgccttttcgagctgcaaagttcagaaatatgaagtgataagaaacaagaatgaagngttcaaaagtacatggtccgaaggctaaag

SEQ ID NO: 54576 - DNA, 101 bp, rice(Oryza sativa)
  misc_feature (71): n=t or c
gaaaggctttgtattttgttttgtggttggggaaggaaaatcaatctcggaccatatccagacattgtccncttgccactactatgaaaatcatctttcgt

SEQ ID NO: 54577 - DNA, 101 bp, rice(Oryza sativa)
  misc_feature (71): n=t or c
tcctcatcagagctgctatcagagctgctgctgtctgtctcaaccttttttgatccattggtagcaagtgnaactggcttcttcaaaggggcagcaggctt

SEQ ID NO: 54578 - DNA, 101 bp, rice(Oryza sativa)
  misc_feature (71): n=a or g
ggggaaaaggacgagggaggtgcgggatgcatttttatagcgcggggaggcgatgaggaggccgcggagtngcggatttggggtggtaacagccagcgacg

SEQ ID NO: 54579 - DNA, 101 bp, rice(Oryza sativa)
  misc_feature (71): n=t or c
tgttagtaggagcaacaccgtcattctttttgaagatcgggaaatctatattttgggtcagtggcggcacngatctgggcgagggtgctatgccctgccct

SEQ ID NO: 54580 - DNA, 101 bp, rice(Oryza sativa)
  misc_feature (71): n=t or c
taattgggcaacatatgcgtcctctccttgcttgtttcttccagaacatggagacgtaggagcaataatcngtgtgaaatgtatggatgaaactgtcttag

SEQ ID NO: 54581 - DNA, 101 bp, rice(Oryza sativa)
  misc_feature (71): n=t or g
cttagtggaggcttaccaaacctcgttgtgactagatttacagatttgataggttccttgggtttactagngatcttaccttgttcgaaggatgggacaac

SEQ ID NO: 54582 - DNA, 101 bp, rice(Oryza sativa)
  misc_feature (71): n=t or c
atgattttcataaatactgtggtttctcctaggcttactacatgcatgctcattagacttttgacatattnaagttataattaataatgtttacacttgaa

SEQ ID NO: 54583 - DNA, 101 bp, rice(Oryza sativa)
  misc_feature (71): n=a or g
ggcccgaacgtatctcacgggtaggttcagaaggattgtcaaggtcaaaggttctaagagaaaggagttcnttcttacccctgaaggccctgatgttttta

SEQ ID NO: 54584 - DNA, 101 bp, rice(Oryza sativa)
  misc_feature (71): n=t or c
tgtgactagccttgctctggtgttgctggaacctcagcatccacctcgtaacagacgggagcattggaacngtcgtattctatgcaacaaacaaagcacac

SEQ ID NO: 54585 - DNA, 101 bp, rice(Oryza sativa)
  misc_feature (71): n=t or g
gactcatcaagcaaactatggcaatgacagatgccatgaagctcgtcgcgttgcaatagaagaatgccttntatcggagagggtaattgtccgcgagaatc

SEQ ID NO: 54586 - DNA, 101 bp, rice(Oryza sativa)
  misc_feature (71): n=t or c
cgggtcgggtcgggtcgccgagtttctttcacagccatggctcctctatctctctctcctgataattcacntggcttctccatggctccatctagcagtag

SEQ ID NO: 54587 - DNA, 101 bp, rice(Oryza sativa)
  misc_feature (71): n=t or c
ttatccacttggttttttttcctgtcatcgggatttaatcttcaacagccatccaggccgaatcctagcgncgctgccacgttaatctgcctccccattcg

SEQ ID NO: 54588 - DNA, 101 bp, rice(Oryza sativa)
  misc_feature (71): n=t or c
atctggtggtcgttgttgcagcttggcatacttacacaactgtagttgttgcctccattattcctcactantgggaacgagaaagtgggaaaaataagatg

SEQ ID NO: 54589 - DNA, 101 bp, rice(Oryza sativa)
  misc_feature (71): n=t or c
cattatcggtggtagcagcggtagaattcattgcaaggatgctgaggccaagaagtagaagcagcaagganattgtgttgttcatggctgggtcgtcgccg

SEQ ID NO: 54590 - DNA, 101 bp, rice(Oryza sativa)
  misc_feature (71): n=a or g
cagctttactttgaatgttccacaggagaatttcagaccatgcaagccagccaggaagtttcaaccatcgnaaatgaggttctgtcagtttccttcatgga

SEQ ID NO: 54591 - DNA, 101 bp, rice(Oryza sativa)
  misc_feature (71): n=t or c
acgcgcatcccaagagtggaaccgcaggcctagctagcatagctggcatcttcaacctccgaatacgtgcncgtacgatgtcggagccgattcttcccatc

SEQ ID NO: 54592 - DNA, 101 bp, rice(Oryza sativa)
  misc_feature (71): n=a or c
aaagaaggagtggaaggaatagaagattatagacctataagccttgttcatggcttcgggaagctcttttncaaggtgctagcaatccgcttacggcccct

SEQ ID NO: 54593 - DNA, 101 bp, rice(Oryza sativa)
  misc_feature (71): n=a or g
tacagaaatggaaatagtgaaggatcagtcagctgctaattactaccagtagctgttaggatgccgctgtnccataatgcaaagcataaaaagagatacat

SEQ ID NO: 54594 - DNA, 101 bp, rice(Oryza sativa)
  misc_feature (71): n=a or c
acgaggcaaaatttgcacagatgtttccgaaattgagaaaaatcctgaacgggcgctcgatgtacgactancccgataaatggtcgcgactgctggaacac

SEQ ID NO: 54595 - DNA, 101 bp, rice(Oryza sativa)
  misc_feature (71): n=a or g
tagcagtaccacccacatgtatcgagacatatcatcgactagcaatagaaaatggcatttacctcccgacntggctgggctaatcggtccacagagatcac

SEQ ID NO: 54596 - DNA, 101 bp, rice(Oryza sativa)
  misc_feature (71): n=t or c
ccgttataaattactcctcgcctcaaaccaccgaggtggtactaaactttgccacaatatacttctgctgntggctgttgccgatctgctgctgctcgcga

SEQ ID NO: 54597 - DNA, 101 bp, rice(Oryza sativa)
  misc_feature (71): n=a or c
atccacaatattattcgcggaatagaactattcaacctaagatattttgtgtttcctaagtggttttcctnagaattcaacaccttcattttagttcttaa

SEQ ID NO: 54598 - DNA, 101 bp, rice(Oryza sativa)
  misc_feature (71): n=a or g
gaagcagatcagtgggaaaagagggagcttcgatgttaatgtgaccaagcaatgtgatgagatcaaagggnaaagagagggctttggcaccaacgcaaaga

SEQ ID NO: 54599 - DNA, 101 bp, rice(Oryza sativa)
  misc_feature (71): n=a or g
ttctcaatgtacatgtaacaatgggtagtaatataacggtcgggctcagtgaaaaagaactagctataacnaactccacaatggttaaaacctatgggagg

SEQ ID NO: 54600 - DNA, 101 bp, rice(Oryza sativa)
  misc_feature (71): n=a or c
atcttgacaccccccccccccccggcggttggtgcgtcgtcgacgatgcacaaactgtatcggaaatcttnaaacagcgctgtgggcaatcccttcgtcat

SEQ ID NO: 54601 - DNA, 101 bp, rice(Oryza sativa)
  misc_feature (71): n=a or c
tttttttttgtaggggaagctggatcctgttgtcggaaggcaaaaccaggttgaccgtgtagtgcagattntcggcaggcggaccaagaacaacccctgcc

SEQ ID NO: 54602 - DNA, 101 bp, rice(Oryza sativa)
  misc_feature (71): n=t or c
agataaatgatttttgaagatacacgagccatagaaaatatacaaaagaacagaaatatgagcgatgctanggtgctctctactggtaatatactttataa

SEQ ID NO: 54603 - DNA, 101 bp, rice(Oryza sativa)
  misc_feature (71): n=a or g
tttttttcctatttgaccaaactaattagtacattggagggattccagtcacaggctgtctgcaaaaatcnattttcacaaatgatcacttataagatagg

SEQ ID NO: 54604 - DNA, 101 bp, rice(Oryza sativa)
  misc_feature (71): n=a or c
ttcactaaatggaactttggcgaaaccttctagtatatgctgggagaggtggatggaatttgtgaaagaanatttgcgtagttactttaggaaatttatgt

SEQ ID NO: 54605 - DNA, 101 bp, rice(Oryza sativa)
  misc_feature (71): n=t or c
ctttgacgcttaatgtgtaccatggtaggttggatagccttgatggccattgtatgtctgttatgcaagtncttaatttgcatttgtgctgtttcttacca

SEQ ID NO: 54606 - DNA, 101 bp, rice(Oryza sativa)
  misc_feature (71): n=a or g
atgaggtttttgttgtagtgtgcgtgcatgcctaagactatgataggttggtgaggagcatctcgacgacncccgtgaggttgcttatttgctccccaatc

SEQ ID NO: 54607 - DNA, 101 bp, rice(Oryza sativa)
  misc_feature (71): n=a or g
cttggccacgaacttgtcccactcactgctgaaatggtgccccattcttcaaatggagtcttattcttctnaacataattggtgttcatgtccgacttcca

SEQ ID NO: 54608 - DNA, 101 bp, rice(Oryza sativa)
  misc_feature (71): n=t or c
aaaaggcacggtttagaagctcatgaaacgtgctctttcgtccaccattccattcctttctgaaaagaacngaacggggcaccacgtcaaggaattcggcg

SEQ ID NO: 54609 - DNA, 101 bp, rice(Oryza sativa)
  misc_feature (71): n=t or c
ttcgccagaaagagcacttgtgtcgctgggagtttgctgctcgattcatcatcctagtcgccagcctcgcngccagagccattttgatctacacaccgacc

SEQ ID NO: 54610 - DNA, 101 bp, rice(Oryza sativa)
  misc_feature (71): n=t or c
gaaaagcgagaaaaataacccccaaaacagtttcaatttgatgggccggattttcaaggctcaatatcttntctcctgggcatgactcgggtgaggcccaa

SEQ ID NO: 54611 - DNA, 101 bp, rice(Oryza sativa)
  misc_feature (71): n=a or c
gccaaatttggtggctgaagtgattagtggccattctggtaatgaagatgtgactgccgataatgttgacnatctgtatttatatcgatctcttgcaggac

SEQ ID NO: 54612 - DNA, 101 bp, rice(Oryza sativa)
  misc_feature (71): n=t or c
cacacacacacagtataaaacgcaataatcagtcaattcctactggtttgtgctacataaggaagtggaanttaaaatggtgcatgagtagcatgcatacc

SEQ ID NO: 54613 - DNA, 101 bp, rice(Oryza sativa)
  misc_feature (71): n=a or g
agcaaaaagctcctgcagagagaatttagcccaacagatgcctgtacaattttttttttgagagctctccnctttgagtacaagctgtagtatctgaacat

SEQ ID NO: 54614 - DNA, 101 bp, rice(Oryza sativa)
  misc_feature (71): n=t or c
tgatgacacatacttcctctgttccaaaataaataaaattagtaggggaatatggcatattttagtactcngaatttgagtagtagtaggatgagttacat

SEQ ID NO: 54615 - DNA, 101 bp, rice(Oryza sativa)
  misc_feature (71): n=a or c
caaatttctcaaggtcaaaattgtcgtcgacatgaatccatatcctaagatcaaagtcccaaccttcttcnttatcctcaaaaactaacctggcaagactt

SEQ ID NO: 54616 - DNA, 101 bp, rice(Oryza sativa)
  misc_feature (71): n=a or g
tcttgttgagattgccaagctgcctaaactttatgaaatactggtttaaacatgtaatcaacaagggtctnttagcttaattaggataggatagcttcctt

SEQ ID NO: 54617 - DNA, 101 bp, rice(Oryza sativa)
  misc_feature (71): n=t or c
tatgataaacaacggttgtagaagatagattagaacatctaaagcggcaccctaatccgccaacgcaaacngctgagacaagtcataccttctgtcagaag

SEQ ID NO: 54618 - DNA, 101 bp, rice(Oryza sativa)
  misc_feature (71): n=a or g
gaacctcacatgccaccaaaagaagaacaatgttagctacatattccacaatgtaagttgcttatagtagntcctatcaatacctttttttttacttttct

SEQ ID NO: 54619 - DNA, 101 bp, rice(Oryza sativa)
  misc_feature (71): n=t or c
atcttcgatttactgtaactcagatattttcttatttttatggccccaccaccttctctcttctcttcctncctccacattccttcctaattaagttaatt

SEQ ID NO: 54620 - DNA, 101 bp, rice(Oryza sativa)
  misc_feature (71): n=a or g
gcatgcagaaaaatactaaggtagaattatgacgttgaattaatcttaaattcagtcctacgagacactgntgattggttcgatatggaaattaaatttgg

SEQ ID NO: 54621 - DNA, 101 bp, rice(Oryza sativa)
  misc_feature (71): n=a or g
gggtacctgtgtgagttcttcattgaggactgcaccacaccagagggtcgcatgtacttcatccagctgcntggtgcaccagacctcactcctgaccccct

SEQ ID NO: 54622 - DNA, 101 bp, rice(Oryza sativa)
  misc_feature (71): n=a or g
caagtagatcaactgttcaaagatttgagtggtttgctaagggagctgatgactttctgaaatctctggantttggagggacacctcgccgttacttgttc

SEQ ID NO: 54623 - DNA, 101 bp, rice(Oryza sativa)
  misc_feature (71): n=a or g
accagtataatacatgctgagagtttgaaacagaaaaatgctgtgactgagctgaatctttgcatttgcanctggcatgtggcatgcaacacataacagcc

SEQ ID NO: 54624 - DNA, 101 bp, rice(Oryza sativa)
  misc_feature (71): n=a or g
tgggaaaggagagggaataactgagcaagtactctacaactgagcgtgtgcagccgcagtagtgacggggnagatgaaagtactccatccgtcccaaaaag

SEQ ID NO: 54625 - DNA, 101 bp, rice(Oryza sativa)
  misc_feature (71): n=t or c
catctaggcctgggtgtaggataaggcaaggaaaaatttacgggacaagaattcgaatctgccaactctgnttgctgttcagctgcgttcacacccctact

SEQ ID NO: 54626 - DNA, 101 bp, rice(Oryza sativa)
  misc_feature (71): n=a or g
ctgctgctcttttccaacttacagtcataagtatgtgtactcgtgtctgtttatttggacaactagcatgntggttcgtgcagattgcgtaggtagcatcg

SEQ ID NO: 54627 - DNA, 101 bp, rice(Oryza sativa)
  misc_feature (71): n=t or c
agatagggaactcagatttcccaatgcagctggaatacctccaaagattgtgttgtttgtaaggatgacangcagaatcggtgcggatatcagtggggcag

SEQ ID NO: 54628 - DNA, 101 bp, rice(Oryza sativa)
  misc_feature (71): n=a or g
tattctatagtgcttacaacagattctgatattttagtcttctagatattgttttgaacatcctccctccntcccaaaatataagaaattttggagggatg

SEQ ID NO: 54629 - DNA, 101 bp, rice(Oryza sativa)
  misc_feature (71): n=a or c
tactgaaggtattttctaactgacctcatgcgccactcttctgggaacttgcattgcttggagaaattaanggcgaggctgatctcgcaaatgagaagaca

SEQ ID NO: 54630 - DNA, 101 bp, rice(Oryza sativa)
  misc_feature (71): n=a or g
ccaataaaaacaagtcttgattttattttgttcattgctccatcttcagtcagtgtccactggtttgtctntcatgcatggatcatttttactcttcaatt

SEQ ID NO: 54631 - DNA, 101 bp, rice(Oryza sativa)
  misc_feature (71): n=t or c
ccaataatcggaggttgcccaccatgatgatgtaggtcactgttgtcagtatgtcgccctgcttttaatcncattcgcttcacaccacacacacagcttag

SEQ ID NO: 54632 - DNA, 101 bp, rice(Oryza sativa)
  misc_feature (71): n=t or c
tcctcctgtccaagaaagaggacccgaatcaactaactgactttcgcccaattagtttgattcatagtttnaccaagatcctgaccaaaattctagcactc

SEQ ID NO: 54633 - DNA, 101 bp, rice(Oryza sativa)
  misc_feature (71): n=a or g
tatcaaaactggacttactgataagatgcatacctaccaggaatcaccagaggcttacctatgtgtggccntttgccaggctagccaagaagggtgctgtc

SEQ ID NO: 54634 - DNA, 101 bp, rice(Oryza sativa)
  misc_feature (71): n=a or c
gtctacaagcgattgatctgcctcgccgcgtagaattttggccatgtaatatataaacctgcgtctaatgntgtttccctgtccctggtcttttggagaga

SEQ ID NO: 54635 - DNA, 101 bp, rice(Oryza sativa)
  misc_feature (71): n=t or g
cacatattttgtataaaaaatgcatctatgtatctcccaaaccagatgatggtactattggaagaaagatnctggaggagattgtagtgggaaaccatcgg

SEQ ID NO: 54636 - DNA, 101 bp, rice(Oryza sativa)
  misc_feature (71): n=t or c
tggtaatcttttcagtttttgaaatcacggtatagctctcggtttggggaatcatgctaggatgtggatcntggctgtgatgtgaacacactcgtgcatac

SEQ ID NO: 54637 - DNA, 101 bp, rice(Oryza sativa)
  misc_feature (71): n=t or c
atgtgatgcgccgaaaatgcgctcacgagtacacatgtagaaaagcaactccttctagatgctatacacanagaaacactagggacctgatttaagcaagc

SEQ ID NO: 54638 - DNA, 101 bp, rice(Oryza sativa)
  misc_feature (71): n=t or c
cagggattaattgattcggaaaggcagtcacagccaggaggagaaccaaatcaaaatcaatcaatcaaacncaccaagaaaccacaagaaccatcaaaacg

SEQ ID NO: 54639 - DNA, 101 bp, rice(Oryza sativa)
  misc_feature (71): n=t or g
caccgccagagcgcatggataaacagtgagttaacactttcccgacccatacctcaatgaccatagttttnctgctcgccgccctcacatgcgctagccgg

SEQ ID NO: 54640 - DNA, 101 bp, rice(Oryza sativa)
  misc_feature (71): n=a or g
gacaaacaacaaaagcaacaataaacaccatcaatttgctttatatgcagatgatgtggacacacgcgccntaacacggagattacgagaagatggtagtc

SEQ ID NO: 54641 - DNA, 101 bp, rice(Oryza sativa)
  misc_feature (71): n=t or c
taatgcgaagcgacgtatataaatgcgtatggtttttgtacatcccgtggctaaatcggtgccctaaagtntttatcttttgtggccgatgaatgaaccga

SEQ ID NO: 54642 - DNA, 101 bp, rice(Oryza sativa)
  misc_feature (71): n=t or g
cgccagggaggggaacttggtgctcaaggttttgccaagatgacttcaagctactccgacaactacatttncaccaactttggctcaggagatccaactcg

SEQ ID NO: 54643 - DNA, 101 bp, rice(Oryza sativa)
  misc_feature (71): n=t or c
agaagagaactgttgtgatgatggcatggaggtgggagagcaacgggtcggagcgacaaaggaagttgtcngagtagccaaggagctacgaggcagcgacc

SEQ ID NO: 54644 - DNA, 101 bp, rice(Oryza sativa)
  misc_feature (71): n=a or g
tggtggccactgggcagggaattgaattaagctgggtccggtactatagatccggaacaaaatttgtgttngggcgatcaacggcacggtattgatgagag

SEQ ID NO: 54645 - DNA, 101 bp, rice(Oryza sativa)
  misc_feature (71): n=t or c
tgttgttcctgaaaataaacttcgaatcattatccttaggaaaatgctctaatgaagtctgatcctccaantgcccagcgtcatcaaggccaggcttccgg

SEQ ID NO: 54646 - DNA, 101 bp, rice(Oryza sativa)
  misc_feature (71): n=t or c
gtgagttccttcgaatagatggacccctttgttcaaatatcgacggtcgcggttaccgatcatattaatcnatttttcaattttttagactaacacttagt

SEQ ID NO: 54647 - DNA, 101 bp, rice(Oryza sativa)
  misc_feature (71): n=t or c
atatactgctggagccaccgccactgatgagcgtcgttgtctccatggttggtgtactctgccaccgttgntgatggcaacattgtcttcaccaccgatcg

SEQ ID NO: 54648 - DNA, 101 bp, rice(Oryza sativa)
  misc_feature (71): n=a or g
cctaagaaatggctaacgaacaatatgacattcaaggctaaatggaccaaatcatttgataccgatgggcntcgttacagctttatgactagtaatatggc

SEQ ID NO: 54649 - DNA, 101 bp, rice(Oryza sativa)
  misc_feature (71): n=t or c
ccaaacctggacttttctcggatggagatcgaagtctcgagtggtacacggcacagcatgaaggcaactanattaccacataatataaccgattaaataaa

SEQ ID NO: 54650 - DNA, 101 bp, rice(Oryza sativa)
  misc_feature (71): n=a or g
gagtgcgatttcgatacccacctgaaggggaagaagcatcaagcgaacacccaggccttactggaacaaancaagaagagctcagtgaatccagagtcaca

SEQ ID NO: 54651 - DNA, 101 bp, rice(Oryza sativa)
  misc_feature (71): n=a or g
taagaacatgtttgtcctccccacttgaatccgatttgagtgattgggtggcatatgtggctaatgcaaancgaacttaatgctgcttaaaccacactcaa

SEQ ID NO: 54652 - DNA, 101 bp, rice(Oryza sativa)
  misc_feature (71): n=a or g
agcgaaagaacacctgtcaccgcaagttttcgttctttacaggctgttccaccacatattactctatagtngtgtaagaggtttaaccgtcaataccttga

SEQ ID NO: 54653 - DNA, 101 bp, rice(Oryza sativa)
  misc_feature (71): n=a or g
gagttatctacaaggattataatgatatacaagggtttcatcggggtttctctctagcctacgttgcatcngcttataaggattatatacaagttagattt

SEQ ID NO: 54654 - DNA, 101 bp, rice(Oryza sativa)
  misc_feature (71): n=a or g
atgattgtcaacatgacaacggataagatcaggtgtagacctttcagaggtataaaatattactccctccntttttaaatatttgacaccattaacttttt

SEQ ID NO: 54655 - DNA, 101 bp, rice(Oryza sativa)
  misc_feature (71): n=a or c
gcttcctttaagataacgaagaatgtccttgatgcctttacaatgtctcttagtaggctctgtgctatacnctgcaagtaagttgacgacaaatgctatgt

SEQ ID NO: 54656 - DNA, 101 bp, rice(Oryza sativa)
  misc_feature (71): n=t or c
agagtaaatgtccgacgctgacgggtagtaatggttcacatggtctgacacccactccttgatagagtccnagacgagcaggccgtcgttggcatacgggt

SEQ ID NO: 54657 - DNA, 101 bp, rice(Oryza sativa)
  misc_feature (71): n=a or g
gaataggttttatggaagattaccgagttggattggagacttccaagaattagtttctctacaactgaggnacaatactttttcttggtaatgttctttca

SEQ ID NO: 54658 - DNA, 101 bp, rice(Oryza sativa)
  misc_feature (71): n=a or g
tcggtttggaccctgggtttttgtatattatcattgggtcggcaaatctactcctcccaaaatagaatttnttatattttagaacgggggtagtagtattt

SEQ ID NO: 54659 - DNA, 101 bp, rice(Oryza sativa)
  misc_feature (71): n=a or c
aaaccaaccctatatatatatctctctctcgcccccgaccactaacatcgtctcatccgccgcctcccctngcctcgccgcgcgcttcctccgcctccgcc

SEQ ID NO: 54660 - DNA, 101 bp, rice(Oryza sativa)
  misc_feature (71): n=t or c
tgttgagatgcaattgatagtgcagtagcaatgagtaagtggttataactccaaggttccgtgtttaattntcaatacgcttataatttcttcttgaaaaa

SEQ ID NO: 54661 - DNA, 101 bp, rice(Oryza sativa)
  misc_feature (71): n=t or c
acctcggcgaccacttcgaaataaacgggggcttcgaaactgcctaattctaatcgacaaacaaagcacanaataaatataagctataaacctactgaaac

SEQ ID NO: 54662 - DNA, 101 bp, rice(Oryza sativa)
  misc_feature (71): n=t or g
gatcttaacgaatgaaccgcggaaactgcacgttcctggaatggagaattggagatggcctccgaaaaaancttctcgtttttcaaaaaaaaaaatgtaaa

SEQ ID NO: 54663 - DNA, 101 bp, rice(Oryza sativa)
  misc_feature (71): n=t or c
ttatggtcgaatatgaacatatttcttctgttcgttagttacacaatatttgattggtgtacatgtatgantgatctgttgcttcatgaattttcactgta

SEQ ID NO: 54664 - DNA, 101 bp, rice(Oryza sativa)
  misc_feature (71): n=t or c
gacactggtcataattgcacttctctggaggccaccaatcaatggtggcgcaaatgaactcgttgctggtngaagcgatcgtctcagcaccccgaacgacg

SEQ ID NO: 54665 - DNA, 101 bp, rice(Oryza sativa)
  misc_feature (71): n=t or c
tctgtttagctcataagtacgtagcttgttgttttcagcctcagaatcatgttcagtgtcactactatctncttcttcttcatcgtcgtcatcatcatcac

SEQ ID NO: 54666 - DNA, 101 bp, rice(Oryza sativa)
  misc_feature (71): n=a or g
cggagaagctacccgcattgtaaatgtaagtctcccgagtggctgtctttgacgaccttgtttccttctcngcaagacttaactgtgaatcattgcgcaga

SEQ ID NO: 54667 - DNA, 101 bp, rice(Oryza sativa)
  misc_feature (71): n=a or c
gacatattaacttgccatcattattcatgctctctaacatttcttattatgccattttgcagtagaggaanctaaggaatttgtatatgtaatagataaca

SEQ ID NO: 54668 - DNA, 101 bp, rice(Oryza sativa)
  misc_feature (71): n=t or c
actcgtatgttgtcctatatctccgagttaacttagagaagaaggtgatcatcgctataaacacaaggccncctcgagaagggaggggcatcgagttacaa

SEQ ID NO: 54669 - DNA, 101 bp, rice(Oryza sativa)
  misc_feature (71): n=t or g
cctacaaggacatagggggccccggatcccaagctggtctgggattcaggctccccttcgtacattttctnaagacataaatcttgtacgtctcgacactc

SEQ ID NO: 54670 - DNA, 101 bp, rice(Oryza sativa)
  misc_feature (71): n=t or c
acaaatagccattcgacagcaagcagcagtggccatgcagtgggcagcagcaatcattccagctcaggttngcatgcaggatcttctgtgcagactcctcc

SEQ ID NO: 54671 - DNA, 101 bp, rice(Oryza sativa)
  misc_feature (71): n=t or c
tggattcgattgcagggaggagtaagaggattgagctgaccttgtgtgtgctggaggcggcgccgttgccnttgttcttgggcacgccagccacggtggag

SEQ ID NO: 54672 - DNA, 101 bp, rice(Oryza sativa)
  misc_feature (71): n=t or c
ttctaggctatgttcagagatattggtagaaacttgtatccttgaaacgtaaaacgatgggatagattagngtataattaattttgtattagctaaaaaaa

SEQ ID NO: 54673 - DNA, 101 bp, rice(Oryza sativa)
  misc_feature (71): n=a or c
tgattcatccaagagctcatctatgactggcataggataagtgcccttttgagtaatagagttcaactgcntataatcaatgtaaaccctccaagatccat

SEQ ID NO: 54674 - DNA, 101 bp, rice(Oryza sativa)
  misc_feature (71): n=a or c
tgacctgacctgacacgattcacctcaagaacacgcagttcttgtgatctttcgtgtcattttcttgctgntgcttctgctcgttggccttccagccattg

SEQ ID NO: 54675 - DNA, 101 bp, rice(Oryza sativa)
  misc_feature (71): n=t or g
tgtcaatgttcaggagaaatggcagtcgaaatccttgaataaacccatgcctctctcccacttgttttttnatttcttccatcacaattcacacactgcca

SEQ ID NO: 54676 - DNA, 101 bp, rice(Oryza sativa)
  misc_feature (71): n=t or c
aggagatgaggcaaaatttagaagcgcgaagggataggcaaaaatttatgagtacacaagagacttaaaantgtcgacattttggaactttgactatggta

SEQ ID NO: 54677 - DNA, 101 bp, rice(Oryza sativa)
  misc_feature (71): n=a or g
cgagaggaaccgatttttgcatttaatttggggcgagagcaaccgaggagggaggtcaatttggggcatgngttcaccggagagagggaaggatggtggcg

SEQ ID NO: 54678 - DNA, 101 bp, rice(Oryza sativa)
  misc_feature (71): n=a or g
taatgccatacataacatggtgcattaacattttgtcaaacaaagagagagagagagtacgtttttgaccngctactttcaccaaaaaaagtgaaacctgc

SEQ ID NO: 54679 - DNA, 101 bp, rice(Oryza sativa)
  misc_feature (71): n=a or g
gttcaaattttatgtatattcaaaaccatgttaaaacattgagttgtcatctctaagcccattatcgtacngtgtgcacaatcataatcctaatccatgtt

SEQ ID NO: 54680 - DNA, 101 bp, rice(Oryza sativa)
  misc_feature (71): n=a or g
actaaaattcaagagtttcatgcctgaggacatgataaatccatagttctttgttggcatggtattcccancagtggaagcactaagggatgctataaatg

SEQ ID NO: 54681 - DNA, 101 bp, rice(Oryza sativa)
  misc_feature (71): n=a or g
ctcaatgaaaacaattgtaaatggaaagatactaccaatgaggatggagaacacagggctgatgtaccatncttgcttgggaatctttcgtggagttttgt

SEQ ID NO: 54682 - DNA, 101 bp, rice(Oryza sativa)
  misc_feature (71): n=a or c
accgcagacgagcaatttcgtgcattagctgaaatctacaccgtttatttaagagtgaacggctgtgctgngctcgtgagacgagggcccatctcctttcc

SEQ ID NO: 54683 - DNA, 101 bp, rice(Oryza sativa)
  misc_feature (71): n=t or g
tcaatttcaaggtgtttttatttttatcgttagaactccgaactgtgaaagatggctggacgcctgcaccngcactgctccacagtactgatgggatttat

SEQ ID NO: 54684 - DNA, 101 bp, rice(Oryza sativa)
  misc_feature (71): n=a or g
tgctagaaagcatgggcatagttcagactgttgcatagaaattgcactgcaactgctcaatgtctgacaanttcttaagtccagcgatagcaaatcatttt

SEQ ID NO: 54685 - DNA, 101 bp, rice(Oryza sativa)
  misc_feature (71): n=a or c
gcaaagatatatcgtgcatatggatggggtaatttgtcggtgcatcggagccgatttgtttaaggttgttnatgtgcatttaggaagttgtttggagtagt

SEQ ID NO: 54686 - DNA, 101 bp, rice(Oryza sativa)
  misc_feature (71): n=a or g
aaagcttccaaagtaaattatccaactgctactgaagattttgaaccctaccagagtaaagggactcacanagtaaatgttacagagtctgattatttacg

SEQ ID NO: 54687 - DNA, 101 bp, rice(Oryza sativa)
  misc_feature (71): n=a or g
cgtggtggcactcgagactagagaaggagctcactttccccatcccctcctactcttttccttcttagctngccatcacctcgctccctaatggtacagat

SEQ ID NO: 54688 - DNA, 101 bp, rice(Oryza sativa)
  misc_feature (71): n=a or g
agtttgaagaattattttgaaactaaacacggcataaagtgaactctcgggaggccgggggcatcgtgaantaaaaaagaaatgttggatatcagagaagg

SEQ ID NO: 54689 - DNA, 101 bp, rice(Oryza sativa)
  misc_feature (71): n=a or g
ttgtacttgcgccgttatcatattttggagattacccatatcttctatatcacatggattcctagtgaacnacatgataatttttcttgcaattgccttaa

SEQ ID NO: 54690 - DNA, 101 bp, rice(Oryza sativa)
  misc_feature (71): n=a or g
aatttagtgaaaaatgatgtgggtgaattagagagggttggttggttctagttgagagtagtatttgggtnaatccaaattgtataatggtattatagcga

SEQ ID NO: 54691 - DNA, 101 bp, rice(Oryza sativa)
  misc_feature (71): n=a or g
actggcgtaaggagcatgggtgtacgagggcgacaactgaaactcaaagttctgaagtatcacgcataacnccatcttggcctcaagcatcgcgaagttct

SEQ ID NO: 54692 - DNA, 101 bp, rice(Oryza sativa)
  misc_feature (71): n=t or g
ggacacagacgaaggagaacacatgaacaaagtggactaacatagtttcagaggcaatgcttaagtaccgntttttttcagaatcttggtcaccttggcct

SEQ ID NO: 54693 - DNA, 101 bp, rice(Oryza sativa)
  misc_feature (71): n=a or c
tgacgcttcacaaaaatccgatttgaattacgcgcaaaatcgccccgaggtcggtctgatcgcagttgtanctgcagtctgcccgggcctagtcgccggtc

SEQ ID NO: 54694 - DNA, 101 bp, rice(Oryza sativa)
  misc_feature (71): n=a or c
cttataatctgaaatggaggaagtaccttatttttaggaaatttacaagatatttaaactgtggatcaatnggaagatattttttttctcaatatatgtaa

SEQ ID NO: 54695 - DNA, 101 bp, rice(Oryza sativa)
  misc_feature (71): n=t or c
ttttcagataatagttagaccttggtttgaacacattgtttaaaattgtgcttcgtcttggctcattggcngcgtttttgtttcaatttcttatccatctc

SEQ ID NO: 54696 - DNA, 101 bp, rice(Oryza sativa)
  misc_feature (71): n=a or c
gaacaggtggatttggtactgtgtacaaggcagtcattcgtggcgcaacagttgccgtgaagattaccaangagataagccaccgaggagtgcgggcgttc

SEQ ID NO: 54697 - DNA, 101 bp, rice(Oryza sativa)
  misc_feature (71): n=t or c
gtttaggcttaacctggtgctgcgtaaccaattgtccctctgaatcccatcgagcttgttgactgttgcancaatgagctttccttaactagaattcttgc

SEQ ID NO: 54698 - DNA, 101 bp, rice(Oryza sativa)
  misc_feature (71): n=a or g
agttcaagcattgaaagtgatcttcatttttaaatgaactgatcagcttggagcgtagttatcactattgnttgatggcttgaaccgagaatgatactcag

SEQ ID NO: 54699 - DNA, 101 bp, rice(Oryza sativa)
  misc_feature (71): n=t or c
ctgttgcgctcgaagacgaagaggatgaagtcggaggtaggaccgaagtttccgttgtagttgaggaaganaccattggtgaggcggagctcagaagcggg

SEQ ID NO: 54700 - DNA, 101 bp, rice(Oryza sativa)
  misc_feature (71): n=a or g
attgaaaaaattattgttcccagtctctttgatttctgtccaaaagagcaggatcgaacaagcctcatgcntacgtatggttttgttttctgtacgcgttg

SEQ ID NO: 54701 - DNA, 101 bp, rice(Oryza sativa)
  misc_feature (71): n=a or c
tatatattgactaccttaggggttccttggttttacaggtcaagtaattgttggaattaatgaatactccntccgtcccaaaaaaagacaaaccctggttt

SEQ ID NO: 54702 - DNA, 101 bp, rice(Oryza sativa)
  misc_feature (71): n=a or g
tacggagggacctatcccaagatatgcttgctgtggtgataccttgcagatcttctctctccaagtgaaanaagcaaaaggtggtcttgactggccgctgc

SEQ ID NO: 54703 - DNA, 101 bp, rice(Oryza sativa)
  misc_feature (71): n=a or g
agcgaccgcccttcttctagaggaagctcgactacatcaacaattggaagtgacttccttgacatacctantttacggggtccaaaatcaagtcattcatc

SEQ ID NO: 54704 - DNA, 101 bp, rice(Oryza sativa)
  misc_feature (71): n=t or c
tgcggtctgcctgttagtaatttgctacacaatcacatccagatggtgaacaccgtccgtccctcctacanacacacacacacgcacacgtatatatatga

SEQ ID NO: 54705 - DNA, 101 bp, rice(Oryza sativa)
  misc_feature (71): n=t or c
agcatgatagtagttcagttgattttagtggaaatgttggtactgtcgaagataacgctcaatgacgggangagcccgttcgttattattgtgtaccgcaa

SEQ ID NO: 54706 - DNA, 101 bp, rice(Oryza sativa)
  misc_feature (71): n=a or g
tttactttaattgatatatagttacatgtatatgagttgtacaacggatcgtacatatagcggtactcccntatataattgtgctacaagctggagtatag

SEQ ID NO: 54707 - DNA, 101 bp, rice(Oryza sativa)
  misc_feature (71): n=t or g
tgaaggtgaggagatggtgaaagaaatacaccaagggatgtgcggtgctcatcaggctgcaagaacagtcncttctaaaatattttgccaaggcatatact

SEQ ID NO: 54708 - DNA, 101 bp, rice(Oryza sativa)
  misc_feature (71): n=a or g
tgctgcatcttgattgcaagctccagaaaaaaatattgtcatgattattgtgccagggggagaagtttcgnttttttatgtgttttgtatgagaccagtgc

SEQ ID NO: 54709 - DNA, 101 bp, rice(Oryza sativa)
  misc_feature (71): n=t or c
ggtcagtggttcaacttctctgacgcagaaacccctccagacattctcgatgcccaacctatcttataccngaaagcagactatggtcaccttctgcagga

SEQ ID NO: 54710 - DNA, 101 bp, rice(Oryza sativa)
  misc_feature (71): n=a or c
ctataatcattggcaaggcaaagagcttctaaacttgctgcaacaaatctactttgtgaagtgttatgctnagcgacaaaatatatatgttttcttgagaa

SEQ ID NO: 54711 - DNA, 101 bp, rice(Oryza sativa)
  misc_feature (71): n=a or g
gtctctttttctcacctttcttctgcagttcttgctgcaattgccatggtcatcgcatgctcttaagcagngcgaaccacccacgaaggtatagcaagtcg

SEQ ID NO: 54712 - DNA, 101 bp, rice(Oryza sativa)
  misc_feature (71): n=t or c
aactctggaattaaacatcagtaccttatctcctgtcttgaatttcttgatcttgatccgcttatcgtgcnagcgttttgttctttccttgtaaatcttgg

SEQ ID NO: 54713 - DNA, 101 bp, rice(Oryza sativa)
  misc_feature (71): n=a or g
aagaacacagcattattttagaactaagggagtacagataaagagatgcttgctcaacaccaaattgatcntctcacgggaccaggagtgcacaaaaagtg

SEQ ID NO: 54714 - DNA, 101 bp, rice(Oryza sativa)
  misc_feature (71): n=t or c
gcgtgccatgccatctgcgtgacacaaaaatctgtcccctttttggcgatgtgtgttgggaagaattgagnaggtgttcatgaaggtgtggtttgcgtgag

SEQ ID NO: 54715 - DNA, 101 bp, rice(Oryza sativa)
  misc_feature (71): n=t or c
agcctcatgcagcatggcccaagcactagagaaatcgaaacgcaacatcctttggccttgaacgccactantcccactaccaccactgctacaccaccagc

SEQ ID NO: 54716 - DNA, 101 bp, rice(Oryza sativa)
  misc_feature (71): n=t or g
tcaatctccttaacgccttctgattgctttcaatgtccatcgacccatgtttccgattgaactctcgcaangagtgcttcaccaactcgttgtcgaaatcc

SEQ ID NO: 54717 - DNA, 101 bp, rice(Oryza sativa)
  misc_feature (71): n=a or g
tgagggaatgccatctcgaacccctgaagttgtagctggtcgagctagtagaggatgtcatcatgtcaatntcctccctatgtcgggcaagatcatgctgc

SEQ ID NO: 54718 - DNA, 101 bp, rice(Oryza sativa)
  misc_feature (71): n=t or g
tgtggctaagtgttcctttgtctcctttgttctctgactttgtattccagataaatttggagctgctatgncacttgtgaagagtgacattggtggtaata

SEQ ID NO: 54719 - DNA, 101 bp, rice(Oryza sativa)
  misc_feature (71): n=t or c
tgtctgtgcaacagctccgtgatcatacaaccttgcgaggccaaagtcgcctagtcgaccgttcatctcancgtcgaggagcacgttgcttgccttgacgt

SEQ ID NO: 54720 - DNA, 101 bp, rice(Oryza sativa)
  misc_feature (71): n=t or c
ggcaaccatgagcttagttctgctgacaaagctgaagagtgtggggcaattgtttgcgatgcttccccctngaggtaaccaatttcccctgcaaaagtcag

SEQ ID NO: 54721 - DNA, 101 bp, rice(Oryza sativa)
  misc_feature (71): n=t or c
ggaaggggaaaaggagagagaagaggagagaggaaggagaaaggatgaagatgatgacatgtggggcacanatgtcggtgggtcccactattttttttagt

SEQ ID NO: 54722 - DNA, 101 bp, rice(Oryza sativa)
  misc_feature (71): n=a or g
agatttagactactccataactcatctttaaacccaactcttattttaggagttgaagttctatcgaacanaccctgaattacaacaacacagccaccacc

SEQ ID NO: 54723 - DNA, 101 bp, rice(Oryza sativa)
  misc_feature (71): n=a or g
gattgattctgttgtgtttgagaattaagatggcggacccagtgagcagcgtgaagcatatcacggagatngctctgaagatcaagcatgcggtggagacg

SEQ ID NO: 54724 - DNA, 101 bp, rice(Oryza sativa)
  misc_feature (71): n=a or c
gatcggtatggtgaacgaataatagatgattttgccaacctctccttcatatgaatcaaaactttgccagnttcttctttagctttattttctacgatact

SEQ ID NO: 54725 - DNA, 101 bp, rice(Oryza sativa)
  misc_feature (71): n=t or c
ccccaggtatttgtccttaaaacttgcacggtcgaccggcaatatagcttcgattccctcctactccctcngttccttaatacagggcgtgagtgttgtat

SEQ ID NO: 54726 - DNA, 101 bp, rice(Oryza sativa)
  misc_feature (71): n=t or c
aaatgcatttcgaatgatttctgtgtagatagaatgtgcttactgccgactgcaatattgttcatgcgtanttgattgagtcaataattaatctcttctac

SEQ ID NO: 54727 - DNA, 101 bp, rice(Oryza sativa)
  misc_feature (71): n=t or c
aacaccattccatttctctccgtcaattctccccaaaacacaattatatctctgtcctccgtcaattattnggctgtgttcgcatgcaccttttcccatcc

SEQ ID NO: 54728 - DNA, 101 bp, rice(Oryza sativa)
  misc_feature (71): n=a or g
cttcctaaccattttactcgtttggatacaccccaaacccaacatctgcttgtgtagaactataatccagncccatacctacggatgggcctggatttgtt

SEQ ID NO: 54729 - DNA, 101 bp, rice(Oryza sativa)
  misc_feature (71): n=a or g
ttcttatgaccatgcactaatgatcggcctccttatgtatttattttggcatcagaaaatttctcgtatcngcgaacgtactggtgggcgtcgcgcgtaga

SEQ ID NO: 54730 - DNA, 101 bp, rice(Oryza sativa)
  misc_feature (71): n=a or g
aaactatctgaaaatacatcagtgggggactgttccttggaatggataacttttggtcaagattcagagangcatgacatcttccgtttaataaagataaa

SEQ ID NO: 54731 - DNA, 101 bp, rice(Oryza sativa)
  misc_feature (71): n=t or c
tacaacatcgatggttgggtgccactgcttaatttgccatctgcaatggacattcgtcgatcgaatcgtantgatcatccttctgaagaaaatcaggacac

SEQ ID NO: 54732 - DNA, 101 bp, rice(Oryza sativa)
  misc_feature (71): n=a or c
gtgcaagctgtggccgactagcactaataggcccaacaacggtagaaagtagaaacaaacgaggaaaatgnatatactttcttcgtaaaaaaaaaatacat

SEQ ID NO: 54733 - DNA, 101 bp, rice(Oryza sativa)
  misc_feature (71): n=t or c
tttccactacgcatatagagtttgcactacatattttcctgtgatgggcggatggcccctcttgttgaaantcaatttttaaaattgattttgagcacttt

SEQ ID NO: 54734 - DNA, 101 bp, rice(Oryza sativa)
  misc_feature (71): n=a or g
tgcatacatcatgcttatcaatggtgtggagcgagacgagcaagagtggaagaaggttttcgtcgaagccnggtttagtgactacaagatcatgccagttc

SEQ ID NO: 54735 - DNA, 101 bp, rice(Oryza sativa)
  misc_feature (71): n=a or g
ccagcaagaggagaatttaacctgaaagcatgaaccataataaccacagatcagcatgaataaagggaganagaaaagaattttgaccactgattgatcat

SEQ ID NO: 54736 - DNA, 101 bp, rice(Oryza sativa)
  misc_feature (71): n=a or c
agtttgtttggtcaaatcacagccttaagaatgcataactgaagtaagcagcggctgcttgatagccctgnagagtaacggaagtggttttacatatgggg

SEQ ID NO: 54737 - DNA, 101 bp, rice(Oryza sativa)
  misc_feature (71): n=a or c
ctgacacatacgactccactctattagctgcaaatgtgactagaacatccactccatcgagacaagaagangacatgtagaagtggtaggacagtattagg

SEQ ID NO: 54738 - DNA, 101 bp, rice(Oryza sativa)
  misc_feature (71): n=a or g
ctagccacaagaatagcagaagcacgagcatcctcatctaaccaagccttgtacatagcatattgactctnataagtctccataacatcagcataagtctt

SEQ ID NO: 54739 - DNA, 101 bp, rice(Oryza sativa)
  misc_feature (71): n=a or g
tgaaaatgtctctccagctacatcgctcactttccaattatgcctcctttgtcaagcgatggcacattatntggtgtcgctttttgaggtctttgcttgta

SEQ ID NO: 54740 - DNA, 101 bp, rice(Oryza sativa)
  misc_feature (71): n=a or g
aggctgttttcctatcgttttcatccctaaaggatttgctattgggcccatatgtcatagatatatgagcngcccacatgttataaacagcgagtgacaaa

SEQ ID NO: 54741 - DNA, 101 bp, rice(Oryza sativa)
  misc_feature (71): n=t or c
gaaacagagggcacggggaggaagaagggaccgaggcgatccttaccactacttacacgatgacacatggngaagggagacaccggcggcgagctccaaag

SEQ ID NO: 54742 - DNA, 101 bp, rice(Oryza sativa)
  misc_feature (71): n=t or c
tacaggtaatgcggaaccttctcataggtgagtttgtggcaccgaaccgcacctcactagaagcatgaaanaggtctacccctatagggctccaagtcatc

SEQ ID NO: 54743 - DNA, 101 bp, rice(Oryza sativa)
  misc_feature (71): n=a or g
gtgttcccctctcttttcccagttatcgctgctgatcctgtcgacaatgagaagaagtacaagaagttccncatgttggatttgtgatgaggtccagttct

SEQ ID NO: 54744 - DNA, 101 bp, rice(Oryza sativa)
  misc_feature (71): n=a or g
gtagtttcaggagcttgctggctaactctaagaagcacctgctggaggctagctaggttttccacaccatnagcaccttccaagatcctaaaccgcagctc

SEQ ID NO: 54745 - DNA, 101 bp, rice(Oryza sativa)
  misc_feature (71): n=a or g
gcataggcttttatgtggctagctaggataaattgatctaatgcgagtttatggatctaattaatctacanataattttgatagctggtagatgcggcgcc

SEQ ID NO: 54746 - DNA, 101 bp, rice(Oryza sativa)
  misc_feature (71): n=a or g
gtagccatttatttcttctctctatttctttctttctttttctagttacaaaaaagtttacagtgcacttntactaaaattacagtctacttacatgccat

SEQ ID NO: 54747 - DNA, 101 bp, rice(Oryza sativa)
  misc_feature (71): n=a or g
ccagtatcaccgcatcgttggtctttgcggctttctctccatgccacagtcgttggccccttcattcagcncccttcttagcatcgaagagagggagggag

SEQ ID NO: 54748 - DNA, 101 bp, rice(Oryza sativa)
  misc_feature (71): n=t or c
ttgaaaaatcgattgatttctgcagacattaattgcagttctgcattacttgatcagaccggagtgctgangtatactgtctgtttctacgaatgcaggag

SEQ ID NO: 54749 - DNA, 101 bp, rice(Oryza sativa)
  misc_feature (71): n=a or g
tattgttgtatgctttgtttgtcgtttagaatccggcagttccaacactccgattttctacgaagtggtcnccgaggttcctatggctcaagagcaaggca

SEQ ID NO: 54750 - DNA, 101 bp, rice(Oryza sativa)
  misc_feature (71): n=t or c
tgacgttagggatagcgtgaccgcggcatccacggagtactcgtcgcgttgcttggccaccatgaggctcnagttgagggcgaggaaggacggcaccatcc

SEQ ID NO: 54751 - DNA, 101 bp, rice(Oryza sativa)
  misc_feature (71): n=a or g
agcacaagctcttcgtttgtttatgtgtttggttcctggataatgcctccatctgtttttccaatcatcgnaaaccttgagacttcatgtcgctaccttgc

SEQ ID NO: 54752 - DNA, 101 bp, rice(Oryza sativa)
  misc_feature (71): n=t or g
attgctgtctggttagtatgccggttaatttgtctccaccagaacaaaaactggtatctttcctagctttnctctcccctacaaaacatgtaaatttctta

SEQ ID NO: 54753 - DNA, 101 bp, rice(Oryza sativa)
  misc_feature (71): n=t or g
gcggatggtttcatttgggtcattggatgttaattattaacgtcttgggaatgagatcctccgacctagangattctacgtcagagggatatcctgattca

SEQ ID NO: 54754 - DNA, 101 bp, rice(Oryza sativa)
  misc_feature (71): n=t or c
tgacaaattggtcttacgatttgtttctaagggcaagttttataatataggttgttgttacctctaatttnatctctatcaccaatctataattaagaggt

SEQ ID NO: 54755 - DNA, 101 bp, rice(Oryza sativa)
  misc_feature (71): n=t or c
ccatttgtttcatttttatttgctttttcctaatccctatcctccttccagtattttcactgtttgggctnggggaggagcagcctattggcagagatcca

SEQ ID NO: 54756 - DNA, 101 bp, rice(Oryza sativa)
  misc_feature (71): n=t or c
agtccattaactttgcctagtaaccggtacatccattggtccatagtattttcttggttcttttaacttgnatgcatggtgcgctctgcatttgtcagtat

SEQ ID NO: 54757 - DNA, 101 bp, rice(Oryza sativa)
  misc_feature (71): n=a or g
ccgtaacacattctaagtgtggctcgtatgcttgttggtccatgaacaaaagctcaatcgtagacattttntctacagttacttatcagcatttggtatca

SEQ ID NO: 54758 - DNA, 101 bp, rice(Oryza sativa)
  misc_feature (71): n=a or g
ggtaaactgaacggggcagagtggttgtcccttcctgactggttcgaatcgagtcgagaagagagatcttnccgaagctgtcggtgataaagttgaggctg

SEQ ID NO: 54759 - DNA, 101 bp, rice(Oryza sativa)
  misc_feature (71): n=a or g
ttactagaaaaaataaggcttggtggctgctcaaaatccatgcatgatgttacctcgtttttggcttgcgngggcatgaatcatttgcactgtatatcagt

SEQ ID NO: 54760 - DNA, 101 bp, rice(Oryza sativa)
  misc_feature (71): n=a or c
aacaggaagcttgtgaaattagtcgaacagtttggactaaggaagtggtctcacattgctcaaattcttcntggaagagttggcaaacagtgcagagaaag

SEQ ID NO: 54761 - DNA, 101 bp, rice(Oryza sativa)
  misc_feature (71): n=t or c
ataagcaaacaataatatatatcacctgtactgtgtggaaagtacgaagcttggagtagtcgaaacatcangtggaggtgaacctgggggcgagggaagcg

SEQ ID NO: 54762 - DNA, 101 bp, rice(Oryza sativa)
  misc_feature (71): n=t or c
aaagtggtataatagtatggattatggggctcacatgtcagttgtacaattaatgtgaaaatggacaccancattattaacattttaagtagcatagatat

SEQ ID NO: 54763 - DNA, 101 bp, rice(Oryza sativa)
  misc_feature (71): n=t or c
agattttcccatgagctgattccagactgtgtgcaacttttgtgttccaattgcaaagtttgcaacccaanccaacccaacacatgggctgatgggctgtt

SEQ ID NO: 54764 - DNA, 101 bp, rice(Oryza sativa)
  misc_feature (71): n=t or c
ttcttgtatcagttaaatagaatgcaacgagcattccattttttcaaaaggctcatttataagtgcaatgntatctttggcggtgcaaacatattgtattt

SEQ ID NO: 54765 - DNA, 101 bp, rice(Oryza sativa)
  misc_feature (71): n=a or g
catctggctgcatttgttacaagccccgtgactgggaaaccatgaatttgagcttggtgtttctccagaangttgaaatcaacaacttgagtggagcagag

SEQ ID NO: 54766 - DNA, 101 bp, rice(Oryza sativa)
  misc_feature (71): n=a or c
gttttgacgatatgatggtatcatggattatcgatcaatcatgccatcgtgatctaaaacggatacacccntgattcgatacgagttaaatcataacttat

SEQ ID NO: 54767 - DNA, 101 bp, rice(Oryza sativa)
  misc_feature (71): n=t or c
acctgctgtgccactgccgcttgttgattcaccctaggtgcggcgtcactgccttgcctaatgcccactgnggtgctgctgccgtttggcaatttgcccgc

SEQ ID NO: 54768 - DNA, 101 bp, rice(Oryza sativa)
  misc_feature (71): n=t or g
ttacttatcgttcttgttttatcctaactcttaagtcaaatattttgtatcttctctagaaatttatcctntttaacataataagatttgttttttaatta

SEQ ID NO: 54769 - DNA, 101 bp, rice(Oryza sativa)
  misc_feature (71): n=a or c
tcccaactcccaagccacgagcaaaatgagcgagcgaactactttctttggtacaccttcggcggttgctngcactatccgcaaggcatgtaccggcgtag

SEQ ID NO: 54770 - DNA, 101 bp, rice(Oryza sativa)
  misc_feature (71): n=a or g
ccgggagtagctggtggtgttcatagcgagcgtggttcatggttctccattcatcttctatcagtgaatcnagcttggcaaaggcaacctcacttatgacc

SEQ ID NO: 54771 - DNA, 101 bp, rice(Oryza sativa)
  misc_feature (71): n=t or c
acactattacccctatgaacacacgtacacataccctacgcctatgagcatccccgaaaaaaaaactggantgtaatttatttagattgttgcggtcacca

SEQ ID NO: 54772 - DNA, 101 bp, rice(Oryza sativa)
  misc_feature (71): n=a or g
taagataagaccgaggaacaccgtgttggaattattggcaacaagtccacaaagtcaaaagtcaaagctcntcctccccatgctgttgcagtctttgccac

SEQ ID NO: 54773 - DNA, 101 bp, rice(Oryza sativa)
  misc_feature (71): n=a or g
gtccatctatcatataacaacaacacaatgacacaacactggataaaaaggactaacaaaccttcttattntcgttacaatgtcacaatatatatcactat

SEQ ID NO: 54774 - DNA, 101 bp, rice(Oryza sativa)
  misc_feature (71): n=a or g
gccaagttgaccgctctctgtcttggacggtatatgcttcgataccatccttagttttgtgcaccaaacantgaatcagaaactgggatactgtcctggtt

SEQ ID NO: 54775 - DNA, 101 bp, rice(Oryza sativa)
  misc_feature (71): n=t or c
gttcatgaacatttaaggcccaaggtgagactttgtcaaccgaatgactaaaaagaagccatatgatgacngatacataatctagctgtactctaattttc

SEQ ID NO: 54776 - DNA, 101 bp, rice(Oryza sativa)
  misc_feature (71): n=a or c
cattcaaaggactaggtatccattttttagacttagtgagatccaacaggactcacttttaaactcctccnacacacatattaaccattgtagagagagcc

SEQ ID NO: 54777 - DNA, 101 bp, rice(Oryza sativa)
  misc_feature (71): n=a or g
atttggagaagcatttgcagaaaccagatccgagaagcaaagaatcaatcagccggaaaaaacagcagagnaatcaaaatctccggcggcctcctccctct

SEQ ID NO: 54778 - DNA, 101 bp, rice(Oryza sativa)
  misc_feature (71): n=a or g
ctgccaaatgttaaaccagtgaatgtgaaggatgaaatagagaaacaagtagctcagatgttgcaccaagncataatccagaccagtgtgagcccatttgc

SEQ ID NO: 54779 - DNA, 101 bp, rice(Oryza sativa)
  misc_feature (71): n=t or c
gttcttcttatagaactacttacccgaaaaaagcctatctataggactgatagaggtgatagtcttgttcnacattttgcctcactactggaagaaggcaa

SEQ ID NO: 54780 - DNA, 101 bp, rice(Oryza sativa)
  misc_feature (71): n=t or c
acatccaattctagcccacctaaaatcaactggattacgagtttggaaaggaaaaaaatacatgaaaggtncctcaacttgtcaccgaattataaaatcgt

SEQ ID NO: 54781 - DNA, 101 bp, rice(Oryza sativa)
  misc_feature (71): n=t or c
gagagtaaggaagaagaagaaatttcatcagtttcatacatacagtctggtgatgtggcagagcgtgttgntgtgatcggagcagtcgcacttgatggccg

SEQ ID NO: 54782 - DNA, 101 bp, rice(Oryza sativa)
  misc_feature (71): n=t or g
cagcagcagaagagaagctcacaacatacctccaccgccgccgccgggggagagacgcctcagagaaacanccgcccctagccgccccgcgctccggcgca

SEQ ID NO: 54783 - DNA, 101 bp, rice(Oryza sativa)
  misc_feature (71): n=t or c
cgaggaattagaatagtttcccatattgcaggtatagtagctaagctctcttgtgacgtgtggctactttnaggatcaggatgattctagctaccgcgtgc

SEQ ID NO: 54784 - DNA, 101 bp, rice(Oryza sativa)
  misc_feature (71): n=a or g
atgaacacaattaactctcatcttcaaaaggcaatcatgtgcttagaataacatgttcaacggtatggacncagcatttgatattgatgcactaaaaccta

SEQ ID NO: 54785 - DNA, 101 bp, rice(Oryza sativa)
  misc_feature (71): n=a or g
agttttatctcgccacaccagttagactggcatgatcaaataacgcaactagcgtgataaaaaaggttcanactttagaactaagttttgaaagtgtttat

SEQ ID NO: 54786 - DNA, 101 bp, rice(Oryza sativa)
  misc_feature (71): n=a or c
ctctattgtcgcacactaattaatggtggtgtatatagaccgtcatatttctccagtagtccagctgcacngcgatcatcacatctgttccattagcagtc

SEQ ID NO: 54787 - DNA, 101 bp, rice(Oryza sativa)
  misc_feature (71): n=t or g
gttcagtttctataatgaaaaacatctggacggacgcgtagtctaatgtgatggagaatattgcaagcccnaatcttaaatcgataatcccttatctaatg

SEQ ID NO: 54788 - DNA, 101 bp, rice(Oryza sativa)
  misc_feature (71): n=t or c
caaaagacatgtgggcctaaatagtcccaaatttcatttgaaataagaggcccaagaagattcgccttagntgtcgaagaccttgacctattgcagtcttg

SEQ ID NO: 54789 - DNA, 101 bp, rice(Oryza sativa)
  misc_feature (71): n=a or g
ccggtttttccccctttcatgaggtgaacgaaatgaagacacccttcgctatcttgatcaggacaccagcngcctccctcctcctccgaagtggaggtctg

SEQ ID NO: 54790 - DNA, 101 bp, rice(Oryza sativa)
  misc_feature (71): n=a or g
cggaggtagtaactttaaatttgccctacaatctatttttatggtaccaaatcctggtcatatgaaaagtncctatgaacataaatccagtgttatcatgt

SEQ ID NO: 54791 - DNA, 101 bp, rice(Oryza sativa)
  misc_feature (71): n=a or g
cgcgtaacttatctggactccacacagtttcacacatcgtattattcggagtgttttaaaaaacaaatccnaattttccgcagcaaaacaaaactgcaaaa

SEQ ID NO: 54792 - DNA, 101 bp, rice(Oryza sativa)
  misc_feature (71): n=a or g
ctgcaacaacagcaacagcaactggagtagcagcagctccggtgcttcctccatcgataatggtggggacnacgacgacggttggctgggtagtcgagatg

SEQ ID NO: 54793 - DNA, 101 bp, rice(Oryza sativa)
  misc_feature (71): n=a or g
agtttctgagtagtttttgtttttcataatttctattcctttcacgatttttcctattcgcatgccggccnttggcttaagcgcccgcatgcggttgcgct

SEQ ID NO: 54794 - DNA, 101 bp, rice(Oryza sativa)
  misc_feature (71): n=t or g
cagtgctattgtctactttgaattaattcccgactatctcatctcacatcaaacatgcattattaccacanaattttgtttcgtctatatattgagaataa

SEQ ID NO: 54795 - DNA, 101 bp, rice(Oryza sativa)
  misc_feature (71): n=a or c
atatataaccatgtggttaggattgttgtagtagccagtacccaattatttcgattttctgcgttcagtgnaatctacatattgattctcatatatgtcaa

SEQ ID NO: 54796 - DNA, 101 bp, rice(Oryza sativa)
  misc_feature (71): n=t or c
ttatttctattttagatgaaatgtgaaattttaaaccactgcaatgtgactacaaacttgaaatgcagcgngtatttgaaatctacaactatatctgtcgg

SEQ ID NO: 54797 - DNA, 101 bp, rice(Oryza sativa)
  misc_feature (71): n=a or g
gataaccaataatttactttggtatccttggctacttcaggttgttgccttgttggattgagatgccatcnaggcatatggtacggataattagcactgac

SEQ ID NO: 54798 - DNA, 101 bp, rice(Oryza sativa)
  misc_feature (71): n=t or g
acagaacaggccacaggcaagtttttgggttattcctaacaagtaatttagtgttatgtgaaggccatgcncttacagtttagtgtctctatttgttcctt

SEQ ID NO: 54799 - DNA, 101 bp, rice(Oryza sativa)
  misc_feature (71): n=t or c
ttgtttcgaagagatggttctcattaatcatggttactgctggtggcgtgtcaacattctggtaataatcnaaagagttcccttggtaaaagttttttttt

SEQ ID NO: 54800 - DNA, 101 bp, rice(Oryza sativa)
  misc_feature (71): n=t or g
ttgatttgacgctgactgcattacgtttgtggagtggccttaagaactcgaaaattcaggagtctggaacnaagtgtatcttgaacttgggttctaaagca

SEQ ID NO: 54801 - DNA, 101 bp, rice(Oryza sativa)
  misc_feature (71): n=a or g
gtaagcagctctctttgatccttttcgcaatcacttcatttctcagccaattaatcactcattctttatanttgcagaagaagaaaactgctgtaaagaag

SEQ ID NO: 54802 - DNA, 101 bp, rice(Oryza sativa)
  misc_feature (71): n=t or c
gtctcatggtgcggcgagggcttgttttgtattctgtctcatggtggcaaaatgtcaggtgaggagccggnggtgagcgctgaggaggagcaggcggcggt

SEQ ID NO: 54803 - DNA, 101 bp, rice(Oryza sativa)
  misc_feature (71): n=a or g
gatattatattcggcctggctacgtggaaggaagctttgccgttaccatggatgagccattgccctatccnaggtttgtccgcactactagaaaagctatt

SEQ ID NO: 54804 - DNA, 101 bp, rice(Oryza sativa)
  misc_feature (71): n=a or g
acaagttggatcagagacacgaatcgtcgctagccaaagcggttgtcaggctgtgatagctgagcaacaantaattaactactaatatcatatttgtaaaa

SEQ ID NO: 54805 - DNA, 101 bp, rice(Oryza sativa)
  misc_feature (71): n=a or g
aattctcaaccaaatcagctcttactataaactataaagttatagccaactgaatcctaaaacttaatatncaaaaatttcgcatcatcatccactaacaa

SEQ ID NO: 54806 - DNA, 101 bp, rice(Oryza sativa)
  misc_feature (71): n=a or g
tttgatggaatcccagcccaactttaggtattgcagtgaactcagattcccaacacccatcggcacgctcnttcctccagcgacgcacagccgcatcagct

SEQ ID NO: 54807 - DNA, 101 bp, rice(Oryza sativa)
  misc_feature (71): n=a or g
caaagccttttgcccgagattgctaaaacgtaagccagctaccgtagatgctttgtgttcgtcaagattcntgttttggcctctccttaattttggctatt

SEQ ID NO: 54808 - DNA, 101 bp, rice(Oryza sativa)
  misc_feature (71): n=t or c
tataagtatttttcagttaatggacctatgcttacccgccaaccaaatggtgttgttgcaaatattaaaanggtaaagctttgaacaacatactctgtgac

SEQ ID NO: 54809 - DNA, 101 bp, rice(Oryza sativa)
  misc_feature (71): n=t or c
accaaaactagctcatttttcagttcatttattccttgccttgaacaatttgagagcctcttcactgctanctgttgtccatctggaagagctccctgtcc

SEQ ID NO: 54810 - DNA, 101 bp, rice(Oryza sativa)
  misc_feature (71): n=a or c
acagaagagaatacaattgctactgcgtactactaattcataacccaattatatctgttgaagcaaagtcnaaatcgaactaatctaaaaaaaaagaagat

SEQ ID NO: 54811 - DNA, 101 bp, rice(Oryza sativa)
  misc_feature (71): n=a or g
ctccaccaagttgatgaaatgatcgatcacctgtcttaccattaccttaccgaaagtccctttatgagatngagacgctaattaaatatagttttccatga

SEQ ID NO: 54812 - DNA, 101 bp, rice(Oryza sativa)
  misc_feature (71): n=t or c
ttcttcctcctcctcatccttcaatgatgatgatgatgattcctccgcctcctccttcttgtccttattgncctcctccttgtatatgtttaaaggttcac

SEQ ID NO: 54813 - DNA, 101 bp, rice(Oryza sativa)
  misc_feature (71): n=a or g
gtgcacattcatacagagcatatgcctaatgtaaataaagtgcccgagcactatttgttctagaagcagtntatagtaattgggactgtttatttgtgaag

SEQ ID NO: 54814 - DNA, 101 bp, rice(Oryza sativa)
  misc_feature (71): n=t or c
tgcatgatcgcgatgcactgagcctgaggattaatttgcttctgcagctgctctgcactttcgaggacatnaggaacgcacccttcggcaaggagatcatg

SEQ ID NO: 54815 - DNA, 101 bp, rice(Oryza sativa)
  misc_feature (71): n=t or c
cgtcttccatttgtgcctcaaaaggcctatgaattccagtgtcccatgactggtagttttgaccgtaaacntcctcatgaagaaacttaagcatgggatga

SEQ ID NO: 54816 - DNA, 101 bp, rice(Oryza sativa)
  misc_feature (71): n=t or c
ggtgtgctcacgtgtgtccaattattggctctgggatataaaccatgcatgtcagttatagttatttacgncacggagaaatgagcgcgcaatgttacagg

SEQ ID NO: 54817 - DNA, 101 bp, rice(Oryza sativa)
  misc_feature (71): n=t or c
cacctgctcatgctgccgccttgttaaattagagaagcagtgtctgtgtctgtgagtctgtcactgcagcnagcgtgcccacaactggcacaggcacaggc

SEQ ID NO: 54818 - DNA, 101 bp, rice(Oryza sativa)
  misc_feature (71): n=t or g
acgtcccatttgtgttctaatcgtgttagtggaagcaacactgacgtgacgtacgtcccctcgaccaaaanaaatagcgatctctccacttcatcaaaagg

SEQ ID NO: 54819 - DNA, 101 bp, rice(Oryza sativa)
  misc_feature (71): n=t or c
aatgtctcaatagccatcaggatcactggaaactatggggaacatcctgacgacaactatgacaagaatgngcttccagtcattagcaacataacgataaa

SEQ ID NO: 54820 - DNA, 101 bp, rice(Oryza sativa)
  misc_feature (71): n=t or c
ggcttgcgtccgaatttgccgactaagagttcatgacgaacacccttagtgaaagtggcaatgatgacatngtcggtaatgtcagagatcttattgcgttg

SEQ ID NO: 54821 - DNA, 101 bp, rice(Oryza sativa)
  misc_feature (71): n=t or c
ctcgtacaaagtatgaggcacgatctttctctcaaaacttctacaaaaaaaggctagccaaacactctctnaatttttgaaaaaaaatggaaaaagaggta

SEQ ID NO: 54822 - DNA, 101 bp, rice(Oryza sativa)
  misc_feature (71): n=t or g
tcatgtgtaaattgactttagtaaaacaataattcaatgctacccaaatttagctcagcatcggtgactgnattgaacaacaatgactaccagatatcaag

SEQ ID NO: 54823 - DNA, 101 bp, rice(Oryza sativa)
  misc_feature (71): n=t or c
ctcaagaacacctaagaataatgtttaacacaagtttcacagtggtacctagtctcaagtggggtccacanaaataaaaaagtattttttttctctctccc

SEQ ID NO: 54824 - DNA, 101 bp, rice(Oryza sativa)
  misc_feature (71): n=t or g
ttcacatcagcaattagctaccatgggagagggtcgcaacgacgtcattagctcttagacatttaaccttnacacaatgatcctatcaccaagaaaaagat

SEQ ID NO: 54825 - DNA, 101 bp, rice(Oryza sativa)
  misc_feature (71): n=t or c
aatagagtaaaaaagactaatccaaggtaggtatttccggaccaaaagaatttctccagacgaattcactnctgtggaggtgacggagatggaggtggtgg

SEQ ID NO: 54826 - DNA, 101 bp, rice(Oryza sativa)
  misc_feature (71): n=t or c
atctatcgtgcgatttaaacaagggtataaatatttctagaactgtcacgtaagacgagggaacgtcttcncgtccctgaacgaaataacttaacaaatca

SEQ ID NO: 54827 - DNA, 101 bp, rice(Oryza sativa)
  misc_feature (71): n=a or g
ccagccaacccgaaagcctgatggactctgtgttggtgtagctgtcaggttgtttatttggatactcgtgnttatgaatcctagatgatttatatacgtgt

SEQ ID NO: 54828 - DNA, 101 bp, rice(Oryza sativa)
  misc_feature (71): n=t or g
ttcacatgacaatctcaggtttcaggatgcttgatttgatctctttgtgcgggagaataacaccgccgttngtatagacctcatcacctacatgtacgtcc

SEQ ID NO: 54829 - DNA, 101 bp, rice(Oryza sativa)
  misc_feature (71): n=t or c
actttgtggcaagtagcttgagagttgtttccaatctccaaatgaatccaaattatatggtccaagctgantgtcaaactcgaaatgtcttactgcttcag

SEQ ID NO: 54830 - DNA, 101 bp, rice(Oryza sativa)
  misc_feature (71): n=t or c
gcgttcgtttgctgttggtgactgggtatatatgaaactccaaccttttgtgcagcagtctgtggtcactngcaccaataggaagttgtcatttcgtttct

SEQ ID NO: 54831 - DNA, 101 bp, rice(Oryza sativa)
  misc_feature (71): n=a or g
tattatcattaatttccattcattgcatagctaagctaaagtcctaaattcctagctggaactctgaacanctataccaaagttttgtcgacgaacatcat

SEQ ID NO: 54832 - DNA, 101 bp, rice(Oryza sativa)
  misc_feature (71): n=t or c
gtgttggagaggtcaaggtgcatgagctcagtgagctcctggaacccagtgaacgggagcttggacatgcngaagttgttaccagagagatcaaggtgttt

SEQ ID NO: 54833 - DNA, 101 bp, rice(Oryza sativa)
  misc_feature (71): n=t or c
acttctcgtgagagtgaaagcagaaggtaacttagcacctgttgttcttgtgcaacccattcagcatgggnaggattgacgacggtgacgtccttctcgtc

SEQ ID NO: 54834 - DNA, 101 bp, rice(Oryza sativa)
  misc_feature (71): n=t or g
aatgatatagccagtgcaagatgcctatgtccattccaaaatcttccctgaaatttgtggctgttacgctngtggtattctttgtatgctctgaatttgtc

SEQ ID NO: 54835 - DNA, 101 bp, rice(Oryza sativa)
  misc_feature (71): n=t or c
accgtggtcaagattttcataaaatggtggatatacatcgacaaatttgttagttgtccatatcttttatnctctcatgatcttattaacatgcatcctgc

SEQ ID NO: 54836 - DNA, 101 bp, rice(Oryza sativa)
  misc_feature (71): n=t or g
gtcaccatgcctatcgcgaggccgaaattttgaattatcatttggaccttttggagttcctgtttatctgntctaaggaacactacagcgtcatctgcata

SEQ ID NO: 54837 - DNA, 101 bp, rice(Oryza sativa)
  misc_feature (71): n=a or c
gagttagtacgattttttttaattttctatacttaccacattttgctgttcacatgaatttcatccaatcnaaaaaaaaacacatttactatagtcacttc

SEQ ID NO: 54838 - DNA, 101 bp, rice(Oryza sativa)
  misc_feature (71): n=t or g
attattttgtttcaagaaaatggaaaacacataaatatgtgagtacgttaaaaaaccctttttcttacttntgtgggaaaaataaaatagtcactcattat

SEQ ID NO: 54839 - DNA, 101 bp, rice(Oryza sativa)
  misc_feature (71): n=a or g
cataaccatttattctttgtttccaggttttgacacaatggggttattcaagggcagcttcacattcatgntgggaatgggatgtggtgtctatgtagctc

SEQ ID NO: 54840 - DNA, 101 bp, rice(Oryza sativa)
  misc_feature (71): n=a or c
gggccatcacagatgagaggatctgtactagtgacgttcttttcgacccataggttttcactgagttgctntatataaaacgaggaacacgattaaggtat

SEQ ID NO: 54841 - DNA, 101 bp, rice(Oryza sativa)
  misc_feature (71): n=a or g
taaccccgtggttaccccgtccctggttaaataactcgacggagaagaactagaggtaggcgtagcttacngggagaggccgatggtggctcgtagtgacg

SEQ ID NO: 54842 - DNA, 101 bp, rice(Oryza sativa)
  misc_feature (71): n=t or c
gccaggtcgtccagggccttctacaccttcatcgacgtcttcatctgctacatcctcttcatcgccgtcgnctacgaggaggccaccgagaccctcgtctt

SEQ ID NO: 54843 - DNA, 101 bp, rice(Oryza sativa)
  misc_feature (71): n=t or g
cccagagaaacaaagttgtccagagtacagctacaggaaaacagaacaaggtaatcacttttcaaccacantgcccagcacatggctgacacgataaacag

SEQ ID NO: 54844 - DNA, 101 bp, rice(Oryza sativa)
  misc_feature (71): n=t or c
catccaaaacctccgggaaccaatcaattatcatctgaagtcgatactgaaaacattgtcccagttactanagaaaaaatatcaccagaacagaagaagga

SEQ ID NO: 54845 - DNA, 101 bp, rice(Oryza sativa)
  misc_feature (71): n=a or g
acctaacatccgaacagtagtcatcatcactcctcaccatccggcgagtatatgaaagactgaaatagganggccgcggtagtcataatcaaaagtagtca

SEQ ID NO: 54846 - DNA, 101 bp, rice(Oryza sativa)
  misc_feature (71): n=a or c
ctggaacttcgacacgatgacaacgctgatggggatcacggtaaacaacatcaaagggatcgaaaatcttnaaaacttgaaggagctatggatcaacggcg

SEQ ID NO: 54847 - DNA, 101 bp, rice(Oryza sativa)
  misc_feature (71): n=a or g
aatgctacctttttcctttaccaccatcagaatattatctgtccaccaactgatgtccttaacatcactcngttgtgtaccattcctgggaggatgaagtg

SEQ ID NO: 54848 - DNA, 101 bp, rice(Oryza sativa)
  misc_feature (71): n=a or g
cacccaccctacctctcactgctaaacgtacaacttttccctaactgaaatgttgtcggatgacaaaaacntcaaccaaaaggaaggattcactgacagtt

SEQ ID NO: 54849 - DNA, 101 bp, rice(Oryza sativa)
  misc_feature (71): n=a or g
gccgtcgcggccgccggcgtagaagacgtacgcctccgacgatgaaaacacggcgaccaaacccagaacgnccataaaccaagctgcatatggccacctcc

SEQ ID NO: 54850 - DNA, 101 bp, rice(Oryza sativa)
  misc_feature (71): n=t or g
ctaaaacataaggctaaagtagtcaggaataggtatggatacttaccgatccaaccattaccacgtcattntcagcaaactgacacatgtcatcactgctg

SEQ ID NO: 54851 - DNA, 101 bp, rice(Oryza sativa)
  misc_feature (71): n=a or g
acaggaaaagaatgcgattacaggaacaaatgtgaataaatgattaccaacgacccctgacagggcagccnccgatgcaggagcttcaggttgcgcatact

SEQ ID NO: 54852 - DNA, 101 bp, rice(Oryza sativa)
  misc_feature (71): n=a or c
cccctgtgtgacgcctgaggttgtgttgaaggcatcggggcatgtcgagaagtttactgacctcatggttnaggatgagaagacaggcacatgctaccgtg

SEQ ID NO: 54853 - DNA, 101 bp, rice(Oryza sativa)
  misc_feature (71): n=t or c
ggaaccatggactgaatcatatatcgtgtgctctatgcagtatggacatttgctaaaatcctactcaattnatggtgtaatgtatatgtagctcctgtaag

SEQ ID NO: 54854 - DNA, 101 bp, rice(Oryza sativa)
  misc_feature (71): n=t or g
gcatgtaaacatatcaatctacccttggtttaatttgtttgaatatgctcgcaaggagctcccaacagttnccccaaacgttgaaactctgttcctgatgt

SEQ ID NO: 54855 - DNA, 101 bp, rice(Oryza sativa)
  misc_feature (71): n=t or c
atcttcataaggccaaatgctgtagcacgttcttcatccatgggcagcgcagcaacggttatatcagcatntgtttctctgtgggcctgaatgaacttttg

SEQ ID NO: 54856 - DNA, 101 bp, rice(Oryza sativa)
  misc_feature (71): n=a or g
agtacttataattgataataggtgatgattttctctaaaccgacacctttaacctattatttagggttttntagtagtgtgccgacggcattcaggtgccg

SEQ ID NO: 54857 - DNA, 101 bp, rice(Oryza sativa)
  misc_feature (71): n=a or g
ccctccttaaaaatcccatttgaacctgccagctaatatattatgattgatgtggatggttgtttggcatnctgtctaaagaattgttatactagatattc

SEQ ID NO: 54858 - DNA, 101 bp, rice(Oryza sativa)
  misc_feature (71): n=t or c
cccgcctttttttcatccgccttttttttccatctgctggttttttaatttattttccggttttttcaccntttttttcactattattgtattatttcgca

SEQ ID NO: 54859 - DNA, 101 bp, rice(Oryza sativa)
  misc_feature (71): n=a or g
attttttgtaatgtagatgtcaatgaatgtgagcaaaatcaaagcccatgcccaaaaggtgcaacttgtcncaatacagaaggatggtaccattgttcttg

SEQ ID NO: 54860 - DNA, 101 bp, rice(Oryza sativa)
  misc_feature (71): n=t or c
acgtacatggatgtcatctacggggtaacgagccatgcctagttcttgagtaacctcaattgaagcggaantgcttttcctcccacctggactgattacac

SEQ ID NO: 54861 - DNA, 101 bp, rice(Oryza sativa)
  misc_feature (71): n=t or c
ctctctaacatgaagtaaagcattgaattacacacacttttgagctgttctctcgttgattctgcatttcngtttgtgtctgcattgctttctctgaagtc

SEQ ID NO: 54862 - DNA, 101 bp, rice(Oryza sativa)
  misc_feature (71): n=a or g
gtattggtcatcctacagtgtttacttgcgtggtccgtatcttgtggaatttgaagggagggtgttgtctntctgtgctccaaaaccctttgaacctgatg

SEQ ID NO: 54863 - DNA, 101 bp, rice(Oryza sativa)
  misc_feature (71): n=t or c
agtcacagagagtgagagaaagagaggctggaagtgggcccggccaggtggtggtggtattcttttagtanatggaaacaataaatttaatttcattattc

SEQ ID NO: 54864 - DNA, 101 bp, rice(Oryza sativa)
  misc_feature (71): n=a or g
attacctagctacttatttactttatttgctatatgagaaagaaatgtatgtttgttacgaaatggaaacnaatgacaattatctgggattaagaaaacaa

SEQ ID NO: 54865 - DNA, 101 bp, rice(Oryza sativa)
  misc_feature (71): n=a or g
ttcggtgggcgagccagtgaatggatttcattttactgaagaatctgaagggcgattggtggttgttgttnttgtgcaggaacagcagctgagcaaggggt

SEQ ID NO: 54866 - DNA, 101 bp, rice(Oryza sativa)
  misc_feature (71): n=a or c
tgttcaacgtgtgacacacttcagtttcccatggagactgattgcatgcccaatttcccacacctcaaggngctcaccctatccaacatcaacatcgtcga

SEQ ID NO: 54867 - DNA, 101 bp, rice(Oryza sativa)
  misc_feature (71): n=a or c
cacattaaagacctaaaagtaaataacgggtaagtagtacctcaagaatatttcccctagtagtctgcaanattgtgttgaattatcctgagctttccttc

SEQ ID NO: 54868 - DNA, 101 bp, rice(Oryza sativa)
  misc_feature (71): n=t or g
gttagttgcacattgcaccacaaaacggtgtcacccgaggtagaagacaaggcaaaaacgtaggcattttngctggaatcaggaaacactcctgaaaagcc

SEQ ID NO: 54869 - DNA, 101 bp, rice(Oryza sativa)
  misc_feature (71): n=a or g
aatccaacaatttttcaacaaaaagaagatggataactgtggaatttttagacgatggatggtgacctcgntgaggtgggtgtagttcatgtctctgatgg

SEQ ID NO: 54870 - DNA, 101 bp, rice(Oryza sativa)
  misc_feature (71): n=a or g
gtctatgtcgcgtcgcgtcgcgcacgcgtgctactgctatgtactagtacctcgtcccctaatactaaggnatattcaatattttcttacgatgtttgaat

SEQ ID NO: 54871 - DNA, 101 bp, rice(Oryza sativa)
  misc_feature (71): n=t or c
gtgtgggtgtcgctggggcacgactttcccaacatggtttcgagccatcgtctctcgtgtcatgctcgttngaccttgcaagccctaacgaggctcgcgcg

SEQ ID NO: 54872 - DNA, 101 bp, rice(Oryza sativa)
  misc_feature (71): n=a or g
ttgttcatagcatattgaagcaataaaaaaaatggcaaatatgtgcatacctggacgggggcgggagccgnagcagcaacgacggtgacgttggcggcggc

SEQ ID NO: 54873 - DNA, 101 bp, rice(Oryza sativa)
  misc_feature (71): n=a or g
gcagttgattcatataaaagaacgaaattaatcaaccgtttcgttggaaattttccgtgaaaatccgaggncaagatattgttggaacatggggccgggtg

SEQ ID NO: 54874 - DNA, 101 bp, rice(Oryza sativa)
  misc_feature (71): n=a or g
ttgagggatgtaggtagtatgaagagaacgttgagacacagacttactatgtaggacctgatcctctgaancatcaagtttcctcgagaataatttccttc

SEQ ID NO: 54875 - DNA, 101 bp, rice(Oryza sativa)
  misc_feature (71): n=t or c
attgctagctctgcaaggaggcccctgatctgcaacaatggaaagaatgaattattgacttaccaaagtgnttcaagtgatatgatggcttatagtgatat

SEQ ID NO: 54876 - DNA, 101 bp, rice(Oryza sativa)
  misc_feature (71): n=a or c
atttggtgctgtcccgtctttcaggacggatcacaaatgcgatatggtttactgtacggtttactgtgacntctgttttgtgtactagtttcccttttttt

SEQ ID NO: 54877 - DNA, 101 bp, rice(Oryza sativa)
  misc_feature (71): n=a or g
ataaaatgtcatactcattggattcctacatgattctaaaacaagaaaagtttcaaaaaacagtcatttgnttagcacacagaaaaatataggaattcttt

SEQ ID NO: 54878 - DNA, 101 bp, rice(Oryza sativa)
  misc_feature (71): n=a or g
tattgtgttatgttgctttcaaagggtatatgactagcaaatcatgcagctagccattaaaaagggaaaantataaatcatttccatggacatcactaata

SEQ ID NO: 54879 - DNA, 101 bp, rice(Oryza sativa)
  misc_feature (71): n=a or g
gacttctagacataatcttggaaagttggaagtcttttgacgaaatgctggttgaatccaagtggtcttcnagatcttgccaaagctgctgtcttattgct

SEQ ID NO: 54880 - DNA, 101 bp, rice(Oryza sativa)
  misc_feature (71): n=a or c
tggagacaagaaaactgcatatgaaaatcattatttttggagatgatcctgaagaaaactttctatgagantaggatgatttttaaaggtgatttgcttaa

SEQ ID NO: 54881 - DNA, 101 bp, rice(Oryza sativa)
  misc_feature (71): n=a or g
taactcaagcttctatttatcattaatcaaaagctggatcattcatgcatatacctttgccgcactcaacntagcagctcggagtcttctttgttcagaag

SEQ ID NO: 54882 - DNA, 101 bp, rice(Oryza sativa)
  misc_feature (71): n=t or c
ccgccaccgcctgcactagcatatctagccacccttccagcattggctagtccaatgctcaccaagacaangaaggtaagagccacaagcttagccattgt

SEQ ID NO: 54883 - DNA, 101 bp, rice(Oryza sativa)
  misc_feature (71): n=a or g
tcctatttttaaactgatcataaattccactcaaatcaacagcatttgaacccggcgtgtgcgacgtgtgnacttctgcaaccctctcaaccaactcactg

SEQ ID NO: 54884 - DNA, 101 bp, rice(Oryza sativa)
  misc_feature (71): n=t or c
cggtggtcagagcaagcgacattgcaaaaatgtgatgagtacaatggtccagcaccatcaattggagtccnggcaacaagcaagctaaggttcaacgcgtt

SEQ ID NO: 54885 - DNA, 101 bp, rice(Oryza sativa)
  misc_feature (71): n=a or c
gtcagacttctggtacaaacagttctcatgttggatatggtgaaatggctacttgcaccaggtgcgggaangttttcaaggttatggatgtggatagacaa

SEQ ID NO: 54886 - DNA, 101 bp, rice(Oryza sativa)
  misc_feature (71): n=a or g
gaagcagctgccagccctgagcgcagagtacaacgctgtgacgtccctgttcgaggcgatgtcggtgaacnagccattgtcgccggaaccgctgcatcagg

SEQ ID NO: 54887 - DNA, 101 bp, rice(Oryza sativa)
  misc_feature (71): n=a or g
cagattatctactacaacacatcaaatgagttgaagatttatagttgtactcagcatactccctccctctnagaaaaagttcaactatagctatgaacctg

SEQ ID NO: 54888 - DNA, 101 bp, rice(Oryza sativa)
  misc_feature (71): n=a or g
atgatgaatcctgctttacttgggccttcaggggcaccactaaatcctccaaactcccaatcctacaactncacaatggatataattaactccaatgatgc

SEQ ID NO: 54889 - DNA, 101 bp, rice(Oryza sativa)
  misc_feature (71): n=a or g
gttagccactcgctcaagctggcagacacttctaggcagcttcgtcacatttgtctcccttatgtcaaggntctctaaatactgtagcttcccaatctttt

SEQ ID NO: 54890 - DNA, 101 bp, rice(Oryza sativa)
  misc_feature (71): n=a or g
atcacgtctatgtgctatgtaggcagtgagaagaccttgggatgaggaaccaactacaatgactgaagagntcatgaaaaccatctcattggaggttgtgc

SEQ ID NO: 54891 - DNA, 101 bp, rice(Oryza sativa)
  misc_feature (71): n=t or g
cgtatccccagtcaaggagactccaatcctgagagaagttcctacaccattgaaggagacacctgttatantgacagaatctccaccccctccaacagata

SEQ ID NO: 54892 - DNA, 101 bp, rice(Oryza sativa)
  misc_feature (71): n=t or c
agcaaaagtttactcaagatgacgtgaaccaaagattcaatttttaattctacagtagttttcaggtttanattatatatagggtttgcactacaaagttt

SEQ ID NO: 54893 - DNA, 101 bp, rice(Oryza sativa)
  misc_feature (71): n=t or c
catccctcacctactaaaagtctaaaatcatacccaccttttaatcgtggcacaaatttagcgtgcttttntgtcagtgttgacatggtgaaatggctcaa

SEQ ID NO: 54894 - DNA, 101 bp, rice(Oryza sativa)
  misc_feature (71): n=a or g
gtgaagatcgatgcagaagttgagaagcatgtgacaaagaagatgccaaagcttaattagttggggtattntgatgatctatcttatgcggttcctagtag

SEQ ID NO: 54895 - DNA, 101 bp, rice(Oryza sativa)
  misc_feature (71): n=a or g
cagctttaattcgccagatttaagctccttttaacagttgccaatgatggttggccaaagatcttgcctcngccatttttatcccgagttttgtgggttca

SEQ ID NO: 54896 - DNA, 101 bp, rice(Oryza sativa)
  misc_feature (71): n=a or c
agacagctgcctgcacgccactggtaggatgatacatgaactatggctggtgttttaggctagggatgtcnttttcgcttacccgttgcttgcctttggct

SEQ ID NO: 54897 - DNA, 101 bp, rice(Oryza sativa)
  misc_feature (71): n=t or c
aggttcctttttacgtgtgttgaggggatctggaataattccttctcaagaaaaaaacgacgcatctggtnatagcgctaaggagagaaatgtgtatgact

SEQ ID NO: 54898 - DNA, 101 bp, rice(Oryza sativa)
  misc_feature (71): n=a or g
ccatatttctttatcacaaagtcacattccagaatactgattgatatatggtatccgtatagtaccataanccctcgtataggaggtatgccttatccatt

SEQ ID NO: 54899 - DNA, 101 bp, rice(Oryza sativa)
  misc_feature (71): n=a or g
aaatatggatctttagtcccagttggtaacgaggtctaacatgttttggaacaaccaaccgagactaaggntctgtttggttgctaccctgatggagattt

SEQ ID NO: 54900 - DNA, 101 bp, rice(Oryza sativa)
  misc_feature (71): n=a or g
atttatttatacccaatctacaactggagtaactgggacgatagaccaattccctgcttcctctttctcangccgacgaaggatatcccctgtggttggcc

SEQ ID NO: 54901 - DNA, 101 bp, rice(Oryza sativa)
  misc_feature (71): n=a or g
atgtcactctcagtccacggcctgctccatgtcgctcttcgtcgacatcagcaatgacctcgtctggttcntcccttgcacgtcattcacctgcgtgttgg

SEQ ID NO: 54902 - DNA, 101 bp, rice(Oryza sativa)
  misc_feature (71): n=a or g
tttgtttgcctatgtccaggacggatatggtcccactgccgaatggtatacttgcctatgtcttatatttncggaaagaagtttgtcggcccaattacacc

SEQ ID NO: 54903 - DNA, 101 bp, rice(Oryza sativa)
  misc_feature (71): n=t or c
gacaagtagggcccaggatagtttcctaacctgcattccttggtaatggacatgcttacagcacgtatatnggtgttgagccgctccatcaaactctcttt

SEQ ID NO: 54904 - DNA, 101 bp, rice(Oryza sativa)
  misc_feature (71): n=t or c
gatttgttttttaagtacgtcatcttcacatcatctaaaccactataaattcggtgttaacattgaaaagngtacggttttgagtaaaatagtgtctgatg

SEQ ID NO: 54905 - DNA, 101 bp, rice(Oryza sativa)
  misc_feature (71): n=a or c
aatattctaacgcaagcaaagccggacaaaaaaaaacaacaggaaaccttacgtattagatatataaattngatcttatctttttgtgattaagaatttag

SEQ ID NO: 54906 - DNA, 101 bp, rice(Oryza sativa)
  misc_feature (71): n=a or g
gatggagtaatttatctatagatgagaatggccttccggcaattctcaattcctggtgcttgaaggttgcntgtagagtagatttttttttcgggcagtgt

SEQ ID NO: 54907 - DNA, 101 bp, rice(Oryza sativa)
  misc_feature (71): n=a or c
cttccgaaatgcaatttttcatggaagttcactgggtcttaaggtaaaaagtttgggaccatgaagggaanaatctttcttttacactttctctcagttgg

SEQ ID NO: 54908 - DNA, 101 bp, rice(Oryza sativa)
  misc_feature (71): n=t or c
aaaaaaaaaagaaaatcaagcctgcgaggggttctttagtcacaaagttgaatggctactctctgaattcncaaggggatggttctccaacaagtcatatg

SEQ ID NO: 54909 - DNA, 101 bp, rice(Oryza sativa)
  misc_feature (71): n=t or c
gtaacaaaggacaacagtcagttgattcataatacttcagtggaacagcttccttttcgttctagtccccntgccctcaagccccagccatgtctgctacc

SEQ ID NO: 54910 - DNA, 101 bp, rice(Oryza sativa)
  misc_feature (71): n=t or c
atgatgcaatgtctgcatatggcgttgattttgatttcggtatcaagcaacttacctccctcaagcatctnggtgtcagcattcattgcagaggtgcaagg

SEQ ID NO: 54911 - DNA, 101 bp, rice(Oryza sativa)
  misc_feature (71): n=a or g
aattctagctctaccacaactgattggtgtaggactgactgacgaatttcgccatggatttggttgtgagnagcagggatggcgtcgtctcagattgccag

SEQ ID NO: 54912 - DNA, 101 bp, rice(Oryza sativa)
  misc_feature (71): n=t or c
ctgtcagtatagactagagactgtattgggctcttgtaagttgtttttctgaagaaaggcaaaagctttgncttgtatatattaatagagtaggagaaaat

SEQ ID NO: 54913 - DNA, 101 bp, rice(Oryza sativa)
  misc_feature (71): n=t or c
ttttaacgagtgacgcactcatacgcatacgtgagtgatccacacacttgttagtgccttagcggtcggtnacaaaccattcattctatctgtcatatcat

SEQ ID NO: 54914 - DNA, 101 bp, rice(Oryza sativa)
  misc_feature (71): n=a or g
tatttatccttttcgatgattcagtgctaccaggaatgctgggatgaattcatattgtgataagaaagagnttactgtagcttttagcaaaactaaaaggc

SEQ ID NO: 54915 - DNA, 101 bp, rice(Oryza sativa)
  misc_feature (71): n=a or g
gcgtccgtgagtccgtcctgtgtgttcaaatcgagccagtgcttattcacgtagaagaaccacaacacaanctagggaggaggagcaggtgtgagtaaacc

SEQ ID NO: 54916 - DNA, 101 bp, rice(Oryza sativa)
  misc_feature (71): n=a or g
cggtcatcacggctccctctcctcctcccatgttggcaagaggcatggcgccacgagcctctggtggtcgntggataacacgggaatgctcttggagtctg

SEQ ID NO: 54917 - DNA, 101 bp, rice(Oryza sativa)
  misc_feature (71): n=a or g
cgtaagggtatgacgtgtgttagtaaggattagtgtgcatacggttagacgagcatttgtgtctgtgtttntactgtgtttcatcgaaaaaaaaaagagaa

SEQ ID NO: 54918 - DNA, 101 bp, rice(Oryza sativa)
  misc_feature (71): n=t or c
cgacaaatcctggagagattgacgaagtcaccacaggctaccactgaaagaggctcttgtaaccactaggntacatgccctttcgcatttcatccgttttt

SEQ ID NO: 54919 - DNA, 101 bp, rice(Oryza sativa)
  misc_feature (71): n=t or c
cgtcgccaccccacacccactctcatcgctatctcctcaccctctcagatcccatcccacacccgctcctncctcccatctccctctccctctccgcccca

SEQ ID NO: 54920 - DNA, 101 bp, rice(Oryza sativa)
  misc_feature (71): n=a or g
gttgcggcggcggcggcggcgtgcaggcgacgatcgggatcgatttcctctccaagacgatgtacctcgangaccgaaccgtacggctgcagctttggtat

SEQ ID NO: 54921 - DNA, 101 bp, rice(Oryza sativa)
  misc_feature (71): n=t or c
ttgtactgcatcgttgatgatgttcatgtttggtatctcgagattgtccaccaatatggcacccatcttantttcagttttatagcatccaggaatcagga

SEQ ID NO: 54922 - DNA, 101 bp, rice(Oryza sativa)
  misc_feature (71): n=a or g
tatttttttcccaccttttatgttacaggttgtgcttgtgtacaactctcttgggtggaaacgggaggatntccttcgcataccggtatgcaaatgttatt

SEQ ID NO: 54923 - DNA, 101 bp, rice(Oryza sativa)
  misc_feature (71): n=t or c
agctagcagtgtcccaatataatccaacgtacaagctggtaataacaataatgcaaaggaatactccctcngacccaaaaaaaaaagacaaaccctggttt

SEQ ID NO: 54924 - DNA, 101 bp, rice(Oryza sativa)
  misc_feature (71): n=t or c
cagctttttcctcgtctccttgaacgtccttgcgtgctttgcttaccaaaaactctttcccatgcactganggattgatgataccacatatggcgactctt

SEQ ID NO: 54925 - DNA, 101 bp, rice(Oryza sativa)
  misc_feature (71): n=t or c
acaggcttcaatttctggtgtttcagtgaaaggtctcaaaggttgtaagaccctaaataaggatcccgatnccaaaaaccctttggaggggaaagaagaga

SEQ ID NO: 54926 - DNA, 101 bp, rice(Oryza sativa)
  misc_feature (71): n=t or c
ggactggaatggaggagagaacagactggaccaacatggagcgaccagcaagagtagtgagacgccccttncaaggtggtaggcgatgagcgaccctgtcc

SEQ ID NO: 54927 - DNA, 101 bp, rice(Oryza sativa)
  misc_feature (71): n=t or c
agagaggaaaattgaagaggttttttgttttcgcttttaaaggcgaattagtctacacactcctctaagcnttttcaactctttcctagatataaatcgtt

SEQ ID NO: 54928 - DNA, 101 bp, rice(Oryza sativa)
  misc_feature (71): n=t or c
aattgttgctgatagaaaacttgtcataaaaccagctgaaagcaggcgatgatttatttggcaaaccttgntgtcgttctcatcaggcatgtctataaaat

SEQ ID NO: 54929 - DNA, 101 bp, rice(Oryza sativa)
  misc_feature (71): n=t or c
aataaatgctgacataccggccagtgtccccttatgtacaatttctctctacttggattctttacgtaccngccatgtttcttataacggccgtgtgctct

SEQ ID NO: 54930 - DNA, 101 bp, rice(Oryza sativa)
  misc_feature (71): n=t or c
tggctccaccttagtgttgtcctgagaaaaatcttgaccaacatcatctggatcaggctcaaattttgtgntaggcacaagaatttcatttccaggtatag

SEQ ID NO: 54931 - DNA, 101 bp, rice(Oryza sativa)
  misc_feature (71): n=t or c
atgatggatatagtcttgcattggggggagttgaaaccatggcctcgtttgattctttcttttatgttggnctgttggcgtatttggaaggaacataacgc

SEQ ID NO: 54932 - DNA, 101 bp, rice(Oryza sativa)
  misc_feature (71): n=t or g
tagggattgacccgtgttccgaatggcccctcacggtcgatgtttagtagctgttccgtctggcgtttttnttcctggaatgtgaaagaaatagaacagat

SEQ ID NO: 54933 - DNA, 101 bp, rice(Oryza sativa)
  misc_feature (71): n=t or c
tggcccgagcacggccgtgccgggccgggccgttcgtttgaccatctatagctatagctagctaattactnaaacagcatgcaaagattaagactgcactg

SEQ ID NO: 54934 - DNA, 101 bp, rice(Oryza sativa)
  misc_feature (71): n=t or c
gaagagcctctatcttcggctcagtaagattgtaatagtcggtcagcgcagcggaatgggctttttccttntccagtttggccttaaggcgatcgacctca

SEQ ID NO: 54935 - DNA, 101 bp, rice(Oryza sativa)
  misc_feature (71): n=t or c
atatttcccttattctacaaccatatgtaagttcactacttgatcactttgaccttaaatcctccttaaanataaaaatactgaaactagcttctacaata

SEQ ID NO: 54936 - DNA, 101 bp, rice(Oryza sativa)
  misc_feature (71): n=a or g
gcgagtgcaatctcgatgttaaattgtgcaaatatgaaatctgggaacatccttcgaccaaaaccacctgnaagaaactgaaaatatgtaccattataatc

SEQ ID NO: 54937 - DNA, 101 bp, rice(Oryza sativa)
  misc_feature (71): n=a or g
ggttgtctaacactacctaagccagccaaacattcgtggctaagttgctaaagttgtggccaagaaaaatnaacccacatcttagcctctttaccgcacat

SEQ ID NO: 54938 - DNA, 101 bp, rice(Oryza sativa)
  misc_feature (71): n=a or g
ggttatggacatgctcggtgatttcacttgacgggtagatttgtgaaagttttacttttgggaaagagctntgtgcaggataaattaatgaatatagctgt

SEQ ID NO: 54939 - DNA, 101 bp, rice(Oryza sativa)
  misc_feature (71): n=t or c
aaatgtgcgtgtaattaaaattaatagggcatatgcgaaatagactacaaatttgttaatagaccttatgngatataggtggtattgcatgtttgaaatag

SEQ ID NO: 54940 - DNA, 101 bp, rice(Oryza sativa)
  misc_feature (71): n=a or g
gtggctaatggagcggaggatactgagctctctcatgatgtctattttccctatgccggatgtttcgagcntgcgttcgatggccacctcgcgtccgtcgg

SEQ ID NO: 54941 - DNA, 101 bp, rice(Oryza sativa)
  misc_feature (71): n=t or c
gtttttgcaattcaatctacaagatgtaaaaggattcaagagtttcttgcccttcttctttctcggtctcnggtagaacgtcgtgctgataacgtattacg

SEQ ID NO: 54942 - DNA, 101 bp, rice(Oryza sativa)
  misc_feature (71): n=t or g
gaaaaatcaaagcgatatataatatgaaacaggtaagtatgaaaacacagtggtaatgggaatcgtcgatntactccgtatgtgttatccggttaataatc

SEQ ID NO: 54943 - DNA, 101 bp, rice(Oryza sativa)
  misc_feature (71): n=t or c
tgctcccttcttcctccagtccactgcccagggcaagttaacggcgttcgcgtacctgaatgttgttgaancatgtggctgagcatcccttcttgctaacc

SEQ ID NO: 54944 - DNA, 101 bp, rice(Oryza sativa)
  misc_feature (71): n=a or g
tggaagactccttaacctaatcctaacataccctgactctatccaactgagctacgtacttatcgtgagcngtggggatatcgttcccattgggcctagga

SEQ ID NO: 54945 - DNA, 101 bp, rice(Oryza sativa)
  misc_feature (71): n=t or c
ccggctcaaaagaacgagattgaacagcaagttcaggaaatgttggacaagggtataattcaacctagttncagcccattttcttctcctgtgctattggt

SEQ ID NO: 54946 - DNA, 101 bp, rice(Oryza sativa)
  misc_feature (71): n=a or c
atggctgtgccgggcgatctatttggcatctatactaacgttagcataccccattattgtttttcgcaggngtatagtgtctcaaaggtgctcatggagaa

SEQ ID NO: 54947 - DNA, 101 bp, rice(Oryza sativa)
  misc_feature (71): n=a or g
gtccggcgagctccccgtagccggcaggttcactcactccactatccaatccatgattcaagagctccgcngcagctggtcgtcttcgggtctgggcagag

SEQ ID NO: 54948 - DNA, 101 bp, rice(Oryza sativa)
  misc_feature (71): n=t or c
gaattggaagacctgtttcagattcagtcactggatccaattctccaagatgaatctgtacatatgcttgngttaaaatggacacaacatttctgcgagga

SEQ ID NO: 54949 - DNA, 101 bp, rice(Oryza sativa)
  misc_feature (71): n=t or c
gacagtacgtgggggtttcaagacacgcatgtcagtaagaaagtctgtgtgtagaaatttgagaggaaacnaagaaattgccataaaagacattctttttt

SEQ ID NO: 54950 - DNA, 101 bp, rice(Oryza sativa)
  misc_feature (71): n=t or g
actgccgacaatggaacaatacaatcgtcaatggttgtaggaacggaaaattacttggatccagagtgcangaagacgggaaagttcaaccgtagctcaga

SEQ ID NO: 54951 - DNA, 101 bp, rice(Oryza sativa)
  misc_feature (71): n=a or c
ggtgagtaagagataagtgaaccaagcattttgatggggagggaccaacaggcagtatcaggcctgcaaantggaaaagacataaaattttcagacttgct

SEQ ID NO: 54952 - DNA, 101 bp, rice(Oryza sativa)
  misc_feature (71): n=a or g
caagtcataccagtcatcacgtccaacaacgcttccatctcgctaccaggagtgcacttgcaatccaggtncgtataatatagtacctccgatctatcttt

SEQ ID NO: 54953 - DNA, 101 bp, rice(Oryza sativa)
  misc_feature (71): n=t or c
tggggtggtacgtaatgcttacctgcagacgtaatgccataaaagttcattcgttctaccacatttggganaaacatgacgaaataataataatatgtact

SEQ ID NO: 54954 - DNA, 101 bp, rice(Oryza sativa)
  misc_feature (71): n=a or g
agcattcattattcaggttgaagaagacctgaaaaatggaattgttgggtctgttccaattccacctgacnatgctgacaaagaagaggttatcaatgcat

SEQ ID NO: 54955 - DNA, 101 bp, rice(Oryza sativa)
  misc_feature (71): n=t or c
ttactgaagtagtcggagatgaagtcgaggtcaccgaacctgttggcttgtcctagggggaatacgaagtngtcggctcctgaagttgatcccattgcact

SEQ ID NO: 54956 - DNA, 101 bp, rice(Oryza sativa)
  misc_feature (71): n=t or g
ggttacgaaaactaaggatttaatatgatatgacgtgagcactgaaatagacaggcttgtttacacctctncctatatgtctatatatgatgctcgagcca

SEQ ID NO: 54957 - DNA, 101 bp, rice(Oryza sativa)
  misc_feature (71): n=t or c
tacagtacaagaagctctcagatacatttgccttgctcgatcacatgcgtcttttcacggttgagaaaagngccgccgcggccaaccaccgccgtggcttc

SEQ ID NO: 54958 - DNA, 101 bp, rice(Oryza sativa)
  misc_feature (71): n=a or c
aagaagaaaaatatgaaatggtattaaagagctctagtgggccactctaaaacctcactcttttatgatanttttttaggttaaaactacactattttaag

SEQ ID NO: 54959 - DNA, 101 bp, rice(Oryza sativa)
  misc_feature (71): n=a or g
aaatgacacctaatgtacctataatcacttaaaggtgccgatttttctttgttttcaatccgtggaggtgnaaaaagacctataggtgccggttttagcac

SEQ ID NO: 54960 - DNA, 101 bp, rice(Oryza sativa)
  misc_feature (71): n=t or c
tctaagattgtatataggaatttatttttttttacaaggtagtacttggcaccactaattaagatccctantgactacgagatagctagttttcgtccgtt

SEQ ID NO: 54961 - DNA, 101 bp, rice(Oryza sativa)
  misc_feature (71): n=t or c
agcgccagaccgacctcccgttcttgcttgctgttgaggatgtgttctccatcaccggtcgtggtaccgtngccactggccgtattgagcgtggcaccgtc

SEQ ID NO: 54962 - DNA, 101 bp, rice(Oryza sativa)
  misc_feature (71): n=t or c
ggtttattgggcctcttcttgttgattgaggcagcgatgtcatactggctctgcaatccagctgcaacttnatcagtgctgcctttcttgcagttgagatt

SEQ ID NO: 54963 - DNA, 101 bp, rice(Oryza sativa)
  misc_feature (71): n=t or c
caatgcatcgcaatcctcaacctcaaaagactgcagagatgcaggcagttctggaagtgattgaatctttntgcagcaatccaaacgcaaattctccagag

SEQ ID NO: 54964 - DNA, 101 bp, rice(Oryza sativa)
  misc_feature (71): n=t or c
aaaaatatattttttgttttgctcagatttaaaaaaatcggcaattgttacattaatgcatttatctggcntatattgtacaaatgaactaaaaataatcc

SEQ ID NO: 54965 - DNA, 101 bp, rice(Oryza sativa)
  misc_feature (71): n=a or g
tcaccctctacgggtaaaattaaaattcccgtcccttaccaaatgcaatctggaactttttcccgtccccntccttcacgcggggaattaatcgtcacgga

SEQ ID NO: 54966 - DNA, 101 bp, rice(Oryza sativa)
  misc_feature (71): n=t or c
cggtccgggtacgtagcttgaatgtcgtttttattttgatcgccagttttcaacattttgtttttaacacncgctctatctctcttacctttgaaccagat

SEQ ID NO: 54967 - DNA, 101 bp, rice(Oryza sativa)
  misc_feature (71): n=t or c
gatggacacatactgacctccaaatggacaaatggaatgactgcccctcgattgaacattggtggaacctngtcgtcgaatcccccagcaccccaagagcc

SEQ ID NO: 54968 - DNA, 101 bp, rice(Oryza sativa)
  misc_feature (71): n=a or g
aacgccggcctatatataccaagcaatttaacctctccttcctcccccaactcatcggtcgattaatctcncctacaaacccatttacatccaatacagct

SEQ ID NO: 54969 - DNA, 101 bp, rice(Oryza sativa)
  misc_feature (71): n=a or g
atgtttcaaatgggtgctcatataaaaccattatatatataatgacgtgaaacaacattatatagcattgncgcataagaggcatatatatgcaaaaacaa

SEQ ID NO: 54970 - DNA, 101 bp, rice(Oryza sativa)
  misc_feature (71): n=a or g
aggcaggccaacctgggaaagatgagaagctcaaacaagaagtgcaagttaggaaaacgaagcttcggagntgttaaagaggtgggtaacgagagaacctt

SEQ ID NO: 54971 - DNA, 101 bp, rice(Oryza sativa)
  misc_feature (71): n=a or g
ctattatgtccacccttgcctcggtgcctaggaaaggtcgagctatattgcaagcccagccgttggccacnctggcttgtggtacgcatggtaagtcttcc

SEQ ID NO: 54972 - DNA, 101 bp, rice(Oryza sativa)
  misc_feature (71): n=a or g
gtaaaattgtgagagtgctccactctgttccgctcctattttagatgaaactggagttggagttggagctntgccaagcaagtcgtcccaagataatatga

SEQ ID NO: 54973 - DNA, 101 bp, rice(Oryza sativa)
  misc_feature (71): n=a or g
gtggccgccgccgcggccgtctcctcgtagtcccagcacggcgcctgcagatctacctatgtcgcattganttaccccccctccgacgatggcttcccgga

SEQ ID NO: 54974 - DNA, 101 bp, rice(Oryza sativa)
  misc_feature (71): n=t or c
gtggcggtgtaccactttctataattacaatggctagtttattagttcataaaccaatggaggattggtcnaaagtgtatgaatctattggttttggggtt

SEQ ID NO: 54975 - DNA, 101 bp, rice(Oryza sativa)
  misc_feature (71): n=t or g
cagcaaatcattagcagattcttggattgccatcatttccaagaactcatgatcttgatgaatctgatcgngagagtgatcaccatcaaattcattagcag

SEQ ID NO: 54976 - DNA, 101 bp, rice(Oryza sativa)
  misc_feature (71): n=t or c
cggaaaaatgttttccacattaataacatgcatgctacacttaattaattgagctgttatacatggccggntatgcatacacaaaaatctttctttttttt

SEQ ID NO: 54977 - DNA, 101 bp, rice(Oryza sativa)
  misc_feature (71): n=t or g
tatacgttcgactccctcgtccgattcccatccaatccaactttatctgccaatcgttacgcttcacgcanaccaacttctctccatgtggctagggcaat

SEQ ID NO: 54978 - DNA, 101 bp, rice(Oryza sativa)
  misc_feature (71): n=a or g
aagcagcaccatgtgcaggtatatataaaatggtgcggggcagatccaagaaaggataaaaggaggggctnaacaaactatacaaaactatagcacccctc

SEQ ID NO: 54979 - DNA, 101 bp, rice(Oryza sativa)
  misc_feature (71): n=t or c
aagatggtagactagggaagttgtggtacacttctcggctagaccaacatctcgtgtggttactacaatcngactgcccttattgttattcttaggaaatg

SEQ ID NO: 54980 - DNA, 101 bp, rice(Oryza sativa)
  misc_feature (71): n=a or g
cctccaagagacctacgagaatttcagctagggacgcccatagtggataaggtcttgtcagactctgaganccgaacgaccatgtaagacctggtcatgta

SEQ ID NO: 54981 - DNA, 101 bp, rice(Oryza sativa)
  misc_feature (71): n=a or g
gaaaattctaatgaagctaaaacaaagctcaaaccattcttttgggataaagtaactgccaatcctgcacnatcgatggtgtgggaccaccttaaatcagg

SEQ ID NO: 54982 - DNA, 101 bp, rice(Oryza sativa)
  misc_feature (71): n=t or c
tgagaaggatgagagatgttcacaaattaggagaagcaaatccctgaatgtgtcccattaatattggaatngaacacccgaagggatcagattagtaccga

SEQ ID NO: 54983 - DNA, 101 bp, rice(Oryza sativa)
  misc_feature (71): n=t or c
attgttcaagcttacaaggggttgaaaaggcgatcaaaagaaaatacgacaacttaaagtggaaacatggncggatattccaatacttgagttagttgttc

SEQ ID NO: 54984 - DNA, 101 bp, rice(Oryza sativa)
  misc_feature (71): n=a or g
aaacctctcccccttaggggttgatggagtggcggtgggtgtcttgtacttgtttagcacctcatctcctnccttggtgtacagagtgcccacatacttct

SEQ ID NO: 54985 - DNA, 101 bp, rice(Oryza sativa)
  misc_feature (71): n=t or c
atggtaacaggatcataaatatcggaaaatcaaaaacataactatactgaggacttgatcagaattaaaangatatcgaaaatattgaattatagaatctc

SEQ ID NO: 54986 - DNA, 101 bp, rice(Oryza sativa)
  misc_feature (71): n=a or c
gctacccagtgccaattgaacaggacagttattcactatgatcattgttgctcttgttatctaggtccatncaaatgccccatgtttgctgtttactccaa

SEQ ID NO: 54987 - DNA, 101 bp, rice(Oryza sativa)
  misc_feature (71): n=a or g
accaatgccactgtgtaagtgttacatcgccttgaaaatccttgcgaagcttctggatgctttcctgtcangggaagtgcgtgttctggtggagagtagag

SEQ ID NO: 54988 - DNA, 101 bp, rice(Oryza sativa)
  misc_feature (71): n=t or c
accatgccattaccatcacgtttttcatattcttcctaaactgcgcatgggatctatctgtcagatgactnaattcatcttcttcctttgaccctccctta

SEQ ID NO: 54989 - DNA, 101 bp, rice(Oryza sativa)
  misc_feature (71): n=a or g
tcactggcaggtgagtcccacgttttttttactttgtcaataccacgtaggcataacgttaaccgaaaccntcatctaaaccgctttggtaccttattttc

SEQ ID NO: 54990 - DNA, 101 bp, rice(Oryza sativa)
  misc_feature (71): n=a or g
atctggaagatatgttacggcacgttgaaccagtggtcataactagtagaagacgaggattggacaattgngaagcgttggaaaaagcagcgaaggaattt

SEQ ID NO: 54991 - DNA, 101 bp, rice(Oryza sativa)
  misc_feature (71): n=t or c
taggaagctctaaatgatgagcttctgaacgtaagatatctaagatggtggcaatacagaagatttgtttntcagcaatggaaaaacacacagataccagc

SEQ ID NO: 54992 - DNA, 101 bp, rice(Oryza sativa)
  misc_feature (71): n=a or g
ggtgatggagatgaggttgctacgacggcaagggagaggaagtggcggcatcgaagcaacagtagtaggcnacgacgaggaagaggaagtggcgacatcga

SEQ ID NO: 54993 - DNA, 101 bp, rice(Oryza sativa)
  misc_feature (71): n=t or c
gatcctgctgcgtctgagggcggaggaggacgtagccgtgcagttggcaagaagccggcgtgatagaaccngctacggtgccaggcagggtgagaggtcgc

SEQ ID NO: 54994 - DNA, 101 bp, rice(Oryza sativa)
  misc_feature (71): n=a or g
gcgactctagttcagcgcagcatgaaaatagtgtaccaatatcttcttcaccattgctgcactccaggaanaaaagactaggagcagtgttatcacgctgt

SEQ ID NO: 54995 - DNA, 101 bp, rice(Oryza sativa)
  misc_feature (71): n=a or c
gggcatgattgatcactttgtcccgttccgtgcaattgctgacgtcacacgccgtctgacgtggcggtgcnacgctggcggcatctccctcgcgattcctt

SEQ ID NO: 54996 - DNA, 101 bp, rice(Oryza sativa)
  misc_feature (71): n=t or c
agagcatcgccctagaagaaaaatccagagatctcctatcttgtactgcaccacattcgtctaccctttanattttctcatccagccatctgaaagacctt

SEQ ID NO: 54997 - DNA, 101 bp, rice(Oryza sativa)
  misc_feature (71): n=a or g
acggctccttgaaccgttttagagaagaacgctcctccagctgttgtgtctaggtgatcgcgggacatcgnggtgagcccattgtaaaagttctgcaggat

SEQ ID NO: 54998 - DNA, 101 bp, rice(Oryza sativa)
  misc_feature (71): n=a or g
acccacttttgctttgctactgatgtactcaacattcttctcaccatggttaccctttgcatgatcctcgncatcttttttgccattgctagctactttaa

SEQ ID NO: 54999 - DNA, 101 bp, rice(Oryza sativa)
  misc_feature (71): n=a or g
ttgtatggaagttaatgttttgaacgaaaggtttattgatgcttatgtgcgattggtcagtgatggtccgntgtggcatgtaacttttgtatatggtgaac

SEQ ID NO: 55000 - DNA, 101 bp, rice(Oryza sativa)
  misc_feature (71): n=t or c
aatggctgaattaagtctatgggattcatcaactatttttctttgacagtgtcgtgccgggctggcccacngtgccgaggaagcagcctaggcatggcccg

SEQ ID NO: 55001 - DNA, 101 bp, rice(Oryza sativa)
  misc_feature (71): n=a or g
gcaaaaatgcccaacaaattcagccttgttttctcattagcaaatagcaatgtaacaagtcacatacactnccgtctgcaagacagtattgtttctaacaa

SEQ ID NO: 55002 - DNA, 101 bp, rice(Oryza sativa)
  misc_feature (71): n=t or c
tcgctccaccacccgtcatccttcgatagtgcgtggacactattgaaccgacccccctgctggccaacctncgcatgcctatgttccatacccaccatcac

SEQ ID NO: 55003 - DNA, 101 bp, rice(Oryza sativa)
  misc_feature (71): n=t or c
tctctaccatccatgtcttctccactacgtctcccgcgctaaccaacctacaaagatcagagatcgcgagngcgagagctcgaggtcgcagaggaggagag

SEQ ID NO: 55004 - DNA, 101 bp, rice(Oryza sativa)
  misc_feature (71): n=t or c
tcttgctcaaacttcttgctctctttcttctctcgggaaaatgaagctgttggcctaacatctggtggcanccttgggattgcctggtcttgatcaaattt

SEQ ID NO: 55005 - DNA, 101 bp, rice(Oryza sativa)
  misc_feature (71): n=a or g
attatattctaatttctcaatctgagttgatctggtattggtttgatcaaatccaactatgtaaatgctgntgattgttgtgctatttacatgttattgag

SEQ ID NO: 55006 - DNA, 101 bp, rice(Oryza sativa)
  misc_feature (71): n=a or g
ttttactcctactgtgcgaaatggcataccaaaaagcgaaagtaaagtaggtataattgccggaatatctnttggtgcaatagttttagtattagcagcat

SEQ ID NO: 55007 - DNA, 101 bp, rice(Oryza sativa)
  misc_feature (71): n=t or c
ggatgaactgcaattacttggtagtcataatctaattggtatttctttcctccaaacagcttcattgagcnaacggtatgctttaagatccaattatctgt

SEQ ID NO: 55008 - DNA, 101 bp, rice(Oryza sativa)
  misc_feature (71): n=t or c
atatatatggatcatatatgtttaagggttaccttgactagtgtccctgcgtactcaagaactcgagcggngagctcgcaggcggctctcatacgagcaat

SEQ ID NO: 55009 - DNA, 101 bp, rice(Oryza sativa)
  misc_feature (71): n=a or g
agcttatataaaaactaaaaaaacatcgatgcgcacgtcgtcgtaagatgatccaaactccaaaggcttcnttaggctatctctaacaataaaacccaaaa

SEQ ID NO: 55010 - DNA, 101 bp, rice(Oryza sativa)
  misc_feature (71): n=a or c
ccatggttccatatatcgtgctgaagttcagagctctttgcgcacaacattggaggtacaatctaactttnttttatagtactagctgaaattatgacatt

SEQ ID NO: 55011 - DNA, 101 bp, rice(Oryza sativa)
  misc_feature (71): n=t or g
ctctttccttctagcagtagcctctactacagtctacacaccctctctatgcaaaacgcaatctcatctcngtgcagccactcatccgatatttcccccca

SEQ ID NO: 55012 - DNA, 101 bp, rice(Oryza sativa)
  misc_feature (71): n=t or c
ctgagctctctttcccttgtgtcaaagcgtctctacaaaattgaggcagagagcaggcatacgatccacanaagctgtagccttggaccagcaacagatgc

SEQ ID NO: 55013 - DNA, 101 bp, rice(Oryza sativa)
  misc_feature (71): n=t or c
acaatttcaagccttcttgcaataactcaatcaaccccaaaacaatttaccaagaacttcgcctttggccntggccgagggaagcccaagtcagggtgcac

SEQ ID NO: 55014 - DNA, 101 bp, rice(Oryza sativa)
  misc_feature (71): n=t or g
aggtaagctttttactgatattatgagatggcatctctaacgcaatcttcatctcataagatgaatctgangcttgatctcgtgagtcttaaaacatgtta

SEQ ID NO: 55015 - DNA, 101 bp, rice(Oryza sativa)
  misc_feature (71): n=t or g
gtgtacatgatgtcgtacagcagggagagctccatctggaggacaacccacgtctcgtcccaacgccattnatcaattgtagctttctcgtcccaggagat

SEQ ID NO: 55016 - DNA, 101 bp, rice(Oryza sativa)
  misc_feature (71): n=t or c
ccaaagcccgaattgaaattcttggacatgaacattgccatgtcgccggcgtcggtaaccatggaccacancggcgtttcgccggcggcgaggtcgcactt

SEQ ID NO: 55017 - DNA, 101 bp, rice(Oryza sativa)
  misc_feature (71): n=t or c
agcatatttcaatctaacaacatattctcttaataattttctctaattcaatgcgtcactcttcattcttncacacaagattgactacatgggcatcgaga

SEQ ID NO: 55018 - DNA, 101 bp, rice(Oryza sativa)
  misc_feature (71): n=a or g
tggtggaatctcaccggagaggctattgtatgacaagtccaatgcttggagattcacaagctgaccatatnatggagggattgtaccagagaagttattct

SEQ ID NO: 55019 - DNA, 101 bp, rice(Oryza sativa)
  misc_feature (71): n=t or c
aactttatggtagattccgaaaaaaatagaaagccagtagtggtcaattaaccctcgagctaatttggtcncatttcctatgagcatatctataatctata

SEQ ID NO: 55020 - DNA, 101 bp, rice(Oryza sativa)
  misc_feature (71): n=t or c
caaggtgaacagtaacatctgcagccacgaactcgtttctattgttgtgccacctcgtacgcatgtgctanggagagacgccaggcgccgccattgccgcc

SEQ ID NO: 55021 - DNA, 101 bp, rice(Oryza sativa)
  misc_feature (71): n=a or g
gatatacatatatttgcgttgcattgagcatgtactatgtagatgtaagaaatatgcacaccttttgttgntgacgaatctcgttgatatcctgtcgatga

SEQ ID NO: 55022 - DNA, 101 bp, rice(Oryza sativa)
  misc_feature (71): n=a or g
ttcgaggttttatcactagtgagttctctccctttgtaatatctatttgaggtttcaccactagtgagcanggtttgcaaaaccgtcagcaaccgtgcggt

SEQ ID NO: 55023 - DNA, 101 bp, rice(Oryza sativa)
  misc_feature (71): n=t or g
ccccatttcgtgaacctccactcaaagccacgcgtgtcccttccctgatcagcatcttttttttctctctntttttcctatttcttcttttattttctccc

SEQ ID NO: 55024 - DNA, 101 bp, rice(Oryza sativa)
  misc_feature (71): n=a or g
gaaataagtaattattactataaagtttgcagcaccaacaactacatcccacattcaatgtgaagacaagnaccaactaacacaggatgaaaaaacattat

SEQ ID NO: 55025 - DNA, 101 bp, rice(Oryza sativa)
  misc_feature (71): n=t or g
tcactacaaaagtttatatttaaatatctaaaattattgaatggtcagctggattagccgagctccgtacnggtgcctacctaccgggtggagtaccgccc

SEQ ID NO: 55026 - DNA, 101 bp, rice(Oryza sativa)
  misc_feature (71): n=t or c
atagctcaattagttgcctaccatgcatggttcaagtcttagacttgatatgaatattcgaatttacgatnaattattcttttagtggtaggtaatgtacc

SEQ ID NO: 55027 - DNA, 101 bp, rice(Oryza sativa)
  misc_feature (71): n=a or g
ccctaattaatcatgcgtgtaactgatgtatgtgtagagtggtggcgacatatcgatctatactagttttncttggattactttgtttgttaattgtatta

SEQ ID NO: 55028 - DNA, 101 bp, rice(Oryza sativa)
  misc_feature (71): n=a or g
gggatgttttttctaaaagagtgtcaatagtggtttagactgagtactatactgtcatttcccaacttcanctctctagttttctgcgcgtacgcttctcg

SEQ ID NO: 55029 - DNA, 101 bp, rice(Oryza sativa)
  misc_feature (71): n=a or c
aaacgtgcacatcgtgcatacacgtccgtattgctgctgtcaggttcgtacaagggcaattgcataataantagccgtgatatacgtacatacggagtaca

SEQ ID NO: 55030 - DNA, 101 bp, rice(Oryza sativa)
  misc_feature (71): n=a or g
aatgtaacattataaaatatcgactgcaacaccattaaccaccaatatgaaacattgagtcttaaagagcnaaacaagaaaagtcatatgagatttacaaa

SEQ ID NO: 55031 - DNA, 101 bp, rice(Oryza sativa)
  misc_feature (71): n=a or g
gggagatttcttatagattagaatcacttgatttgtttgaagatatcatgctcaaaactcctctagctccngcgactaacaatagcatgacgagttaaggt

SEQ ID NO: 55032 - DNA, 101 bp, rice(Oryza sativa)
  misc_feature (71): n=t or c
attgcccttctaccaaaaaagactgatgctctaagggtaggtgattacaggccaatcagcctcatacatgncttcggaaagctcttctccaagttactagc

SEQ ID NO: 55033 - DNA, 101 bp, rice(Oryza sativa)
  misc_feature (71): n=a or g
gtcaccatggcgattggctccgagctccctgctcctcttgcctccaagctccttaagtttgacggggctcnacagctaccatcgtctctccccactacaag

SEQ ID NO: 55034 - DNA, 101 bp, rice(Oryza sativa)
  misc_feature (71): n=a or g
gaaatagtataaatgaagtattccgtccggtttttaatatataataatatcgttggcttttgaatatacgntgaaatccttcattttttttaatgattttg

SEQ ID NO: 55035 - DNA, 101 bp, rice(Oryza sativa)
  misc_feature (71): n=a or g
actctttgctttattgctattggacaaaattttgctacacctaatatgccactaccgttagcccctgcacntgaactcgccgttagttcctcggatcatgt

SEQ ID NO: 55036 - DNA, 101 bp, rice(Oryza sativa)
  misc_feature (71): n=a or g
gaaagatattgtggaaagatccagagcggcagagaagcaaaagattgtgaaagcattgcttgaaaatgatnatataatggtgcttccaatagttggaatgg

SEQ ID NO: 55037 - DNA, 101 bp, rice(Oryza sativa)
  misc_feature (71): n=t or c
ctgcgacaagtcgcaccgctacacgaatcttaaagcatcggcattgctgtccacttcccctgaatgatgtntgatgtttctgtatatcagttcctctactc

SEQ ID NO: 55038 - DNA, 101 bp, rice(Oryza sativa)
  misc_feature (71): n=a or c
tctttaggcatatcctgaagaaccatctgttgaagtgagttaagatattgcaagcctgctggaacagctancaaacttctcaaaccaatgagctttacata

SEQ ID NO: 55039 - DNA, 101 bp, rice(Oryza sativa)
  misc_feature (71): n=t or c
cgacactgccttaattgtactgtctgcagcctgcctagctagcatagggttcaaaattttggatcgaattnggaaatttcggttctatcgatccctccgat

SEQ ID NO: 55040 - DNA, 101 bp, rice(Oryza sativa)
  misc_feature (71): n=a or g
taaaagctcttgaggctgggctcatctggagagtgggcgatggtaacagaattgatatttggcatgacccntggatcccagccggattctctcggaggccg

SEQ ID NO: 55041 - DNA, 101 bp, rice(Oryza sativa)
  misc_feature (71): n=t or c
ccacactgccttggtcaccatttcttttattcctgtttttgttgccatcttacttgggccccgtttagttnccacaaactttttcccaaaaacatcacatc

SEQ ID NO: 55042 - DNA, 101 bp, rice(Oryza sativa)
  misc_feature (71): n=a or g
agcttccatgcttcaaccttctctgcatctagagcttcctagactgaattcttctcatcattcaggcacgnatacttggcatcaagttcattgtatgatgc

SEQ ID NO: 55043 - DNA, 101 bp, rice(Oryza sativa)
  misc_feature (71): n=t or c
aagcaccggccatagcttgttgctgcatgatgaccatgagatgacaaagtaaacatgaagatattctcttngtccctaaatatttgacgccgttgattttt

SEQ ID NO: 55044 - DNA, 101 bp, rice(Oryza sativa)
  misc_feature (71): n=a or g
ttagtccctgatattctatattgtccaaacaagtcactaaagtttattgtgtgattttaatatagtccttngacccactaaaaagccacgtgcacacacat

SEQ ID NO: 55045 - DNA, 101 bp, rice(Oryza sativa)
  misc_feature (71): n=t or c
ttattatttcctagactaagataggctatgttcggcactatcatatctgaggttctactccctcgtttttnacatgtacacttctcgaacggctaaacgat

SEQ ID NO: 55046 - DNA, 101 bp, rice(Oryza sativa)
  misc_feature (71): n=t or c
agaaatgttgacaggagagcgcccgtgactgattggacacgtgcacgaagatactagtagtacatagaagnattattcactctgcttaatttgttggtaat

SEQ ID NO: 55047 - DNA, 101 bp, rice(Oryza sativa)
  misc_feature (71): n=t or c
taggggtctagtgattttggagaaatcctttatgcagcacatatagaaccccgcaagctacggactccctngacattgacaagaggtgggagttatcgaat

SEQ ID NO: 55048 - DNA, 101 bp, rice(Oryza sativa)
  misc_feature (71): n=t or c
accttgccatgaggggcgggcttcggcatgtgtttagcatgattatgtggttcagcctcaacattgtgcantgctatgttgatttcggccagatcgccctt

SEQ ID NO: 55049 - DNA, 101 bp, rice(Oryza sativa)
  misc_feature (71): n=t or c
gaatcataacatccttttgcccagcacaccttgtagatggcaatatgcgcacgcacagccatgccttgggnggtgccattggcatagccaaataggttggc

SEQ ID NO: 55050 - DNA, 101 bp, rice(Oryza sativa)
  misc_feature (71): n=t or c
aaagccggaacgccaccaatatggcagcgggaataagttccctctaggtctctaattttaaagtatggttngaattatatcattgaaccgtagtcccttaa

SEQ ID NO: 55051 - DNA, 101 bp, rice(Oryza sativa)
  misc_feature (71): n=a or g
tgagtgggggccaagggctccgcttgttacactctagatccgcccctgattcttatgaatgtttgttaggncttactactgatgacgattatcggtggtgt

SEQ ID NO: 55052 - DNA, 101 bp, rice(Oryza sativa)
  misc_feature (71): n=t or c
attagaattagtgaaatcaccaattgtcgcttgttcctgtagagacaattgtagttgctgcctttgcttanataaacggatggaaagacagcatgaaatac

SEQ ID NO: 55053 - DNA, 101 bp, rice(Oryza sativa)
  misc_feature (71): n=a or g
gcaggagtactgctcaaacaaactgtacatgcaacacaccccttaggcccattgcaaaactgacatagaantacagaaagtacaaagcaaatatcacagta

SEQ ID NO: 55054 - DNA, 101 bp, rice(Oryza sativa)
  misc_feature (71): n=a or g
caactatcgtaacaaattagtcgtacgtatagcaacgccgtcgttataatgagtgggaataattcaactcngaataggaacgaatgtaataatgtgtgcta

SEQ ID NO: 55055 - DNA, 101 bp, rice(Oryza sativa)
  misc_feature (71): n=t or g
aagacatcaatcatctagtcaatttatgcctcttaaatgctagaaaagaactctgttccaatattcctggnattggcaagatgaagtatttacaaaggttg

SEQ ID NO: 55056 - DNA, 101 bp, rice(Oryza sativa)
  misc_feature (71): n=a or g
ctataaatttagatcccctaataattggtgtgtgttgatttggtcgattatcgaatagatctaccacttcnatcgcaactattcctatgtgcttaatcacc

SEQ ID NO: 55057 - DNA, 101 bp, rice(Oryza sativa)
  misc_feature (71): n=t or c
gaagaaattagcatgagcacatcttggcgacatgtatttttgtaacaactagcagaagcagaccggtcacnggtgatactatgaatcccattgcctaccat

SEQ ID NO: 55058 - DNA, 101 bp, rice(Oryza sativa)
  misc_feature (71): n=a or c
aacatatcacttcctcgagaagatttttgtttaaaaaattatgtacatggctactggctacctttgctgtnttgcagatcgaattgtcacataaacgccac

SEQ ID NO: 55059 - DNA, 101 bp, rice(Oryza sativa)
  misc_feature (71): n=a or c
acatgagaatgatttcatcttgtgatttacagcatatggaaattcccgtcagtcagtatcagaagaggaantgaaagagaagcgtgccaatctgaatggtg

SEQ ID NO: 55060 - DNA, 101 bp, rice(Oryza sativa)
  misc_feature (71): n=a or g
tatgactgatggtctgaatactcaccgtctgatgaaactgtcgctttacagaagtcctgaaatagccgagnaggtgcgacgacgcagcttcgtgtgggcag

SEQ ID NO: 55061 - DNA, 101 bp, rice(Oryza sativa)
  misc_feature (71): n=a or g
atagtaaatctgatatctgactatatcggtaacgtaaattaccagaggttgtccactataagcaccataantgcctccataataggtactgatatatggat

SEQ ID NO: 55062 - DNA, 101 bp, rice(Oryza sativa)
  misc_feature (71): n=t or c
atgttggactagataggcagtccgacagtcggactaggaaaagctaaaatgcatggtctagttcgatttanagagaaggtgtcaagccatgaagttcccct

SEQ ID NO: 55063 - DNA, 101 bp, rice(Oryza sativa)
  misc_feature (71): n=t or c
tctctgtttctcctttgatctctttaaactacattctcctaggatgtaaatgcaactacttgtactcttgntctgtaaaatggcaattagcaatctatcat

SEQ ID NO: 55064 - DNA, 101 bp, rice(Oryza sativa)
  misc_feature (71): n=a or g
ttgaatggaaagtatgcgctggcaaaccataagtctagtggggattctgtcaagcaaacacatggatatgncagccctaatggagggaagaaaaagtatga

SEQ ID NO: 55065 - DNA, 101 bp, rice(Oryza sativa)
  misc_feature (71): n=t or c
gttgccccagccttaatttttccataactataaccattataagaacagtagagctcttgcgttataatgtngcttaaaaattcgcgagggtccatgaccat

SEQ ID NO: 55066 - DNA, 101 bp, rice(Oryza sativa)
  misc_feature (71): n=a or g
ttccacagtataaatgaccggtttcactgatctagcgcttacgtatcaaaaacggaagtgagccccacatntcaaccctcactctcctcccatcttctccc

SEQ ID NO: 55067 - DNA, 101 bp, rice(Oryza sativa)
  misc_feature (71): n=t or c
atatcgttaaaaaaatattccttccatctagtaatatggtaacatgtcctattctactattacgaatcaancaggatgtgattttggaacagatatagtag

SEQ ID NO: 55068 - DNA, 101 bp, rice(Oryza sativa)
  misc_feature (71): n=a or g
tgtaatagtaaccatcatatgccattagcttcccaagttgacacttcagctgctggacacgtcgaggcgcnacatggctccggcgccggccttgcgtcctc

SEQ ID NO: 55069 - DNA, 101 bp, rice(Oryza sativa)
  misc_feature (71): n=a or c
actgcctacgtggcgctccatgatggtacacattttgcatttgtccttctaggcaggagtatacgttgcanaaaagtgtgggcagtgaacagcagcggtga

SEQ ID NO: 55070 - DNA, 101 bp, rice(Oryza sativa)
  misc_feature (71): n=a or c
gcctgaatccattagtcctagttgattcatcactgcttgatcgaacactggaattactctcttccaggacnagattggagctttctttcagctgcctgcct

SEQ ID NO: 55071 - DNA, 101 bp, rice(Oryza sativa)
  misc_feature (71): n=a or g
ggcgaactccccgatctatgcgcatgccatatgttttccaaatagaaactagacatagctatagaagaaangtaagatggtctaaactacaataaatgtaa

SEQ ID NO: 55072 - DNA, 101 bp, rice(Oryza sativa)
  misc_feature (71): n=t or c
atcaaacgttgaagcaccagctatcctcgcaacgccatttttgtttcaattgccataaattgcgacaacancgcatcgccatttattaaactaacaccata

SEQ ID NO: 55073 - DNA, 101 bp, rice(Oryza sativa)
  misc_feature (71): n=t or c
tgcttttgggaatctttctaagctgcaagcactggtcctcactagcaacaggctcacagatgaaataccancatctctaggcagcagcttttctctcagat

SEQ ID NO: 55074 - DNA, 101 bp, rice(Oryza sativa)
  misc_feature (71): n=a or g
gagttcagttttgtctacctcaaaaaaaaaaaaattcagttctgtagatgctgttcttccttccatgttcntgtggggatttatgccctaaaatacatatg

SEQ ID NO: 55075 - DNA, 101 bp, rice(Oryza sativa)
  misc_feature (71): n=a or g
ggttcagattcttatgtatgaatcaaaaggcttcgttcaaatgatttgtgcacggttggcaccaatgtatntttgatcggagactgtattagcatttgaag

SEQ ID NO: 55076 - DNA, 101 bp, rice(Oryza sativa)
  misc_feature (71): n=a or g
tagttgcttgtggcaaactcataacaggtccaactctaaccacaacatgtgtaacttgcttacttgcagcntatatagtcttctttttattccaagatcac

SEQ ID NO: 55077 - DNA, 101 bp, rice(Oryza sativa)
  misc_feature (71): n=t or c
tggatgattcccgttatccagaaaactcggcgagctaatccatccgcaggtacatcggaacagccgcacgnggccatggcggcgctggagtatgcgctatg

SEQ ID NO: 55078 - DNA, 101 bp, rice(Oryza sativa)
  misc_feature (71): n=t or c
tcgctaggaaatctgtctgcatcacttctagacccctgatatatgttgagaccatcccaagagaaaagtcncattgaatattttaagtttccccgcaaaaa

SEQ ID NO: 55079 - DNA, 101 bp, rice(Oryza sativa)
  misc_feature (71): n=t or c
tttgattttcaattttgtttaatttggctatctctttgcgaaagggcctatagcctggtgattacaagagnctcagtagcacctgaggtcctgggttcgac

SEQ ID NO: 55080 - DNA, 101 bp, rice(Oryza sativa)
  misc_feature (71): n=t or g
gttagcagcacaggggtgtgtgtgagcttcggctctgttagtaggagctgtgtcacctctgattttttttncagggtgtgtgtgtttgctctcttttgttt

SEQ ID NO: 55081 - DNA, 101 bp, rice(Oryza sativa)
  misc_feature (71): n=a or g
gcagtagccaagagcgagggatgcatataataccatagaccttaacgtgatagtactcattccaccccaanttataaggcacgcacacatttcaaaattca

SEQ ID NO: 55082 - DNA, 101 bp, rice(Oryza sativa)
  misc_feature (71): n=t or g
gcagactgcacaggggacagtaggcaaattgatcagctagctcatgagctccttctctgctcgcacaggcngcgggccgccatggacatgtgcgtggtcag

SEQ ID NO: 55083 - DNA, 101 bp, rice(Oryza sativa)
  misc_feature (71): n=t or c
cgtgtgcaggaacaggacatctgtgtctttgtaccaactaaggatgcaagaagaaatttcacgtttacggntcatctgcttcgcgtagcggcagcttattc

SEQ ID NO: 55084 - DNA, 101 bp, rice(Oryza sativa)
  misc_feature (71): n=t or c
ggggagggttgagattttgacgtgctttctctggtagagatgaagagagaggggataaaccgaagataaanatagttataaagtgaaatgtttttgaagaa

SEQ ID NO: 55085 - DNA, 101 bp, rice(Oryza sativa)
  misc_feature (71): n=a or g
gaaagactatgaaacacatatgttgtcataactacacgctactacatgaacctctattgatgttggttggnaattgattatagatatcggattctcaactg

SEQ ID NO: 55086 - DNA, 101 bp, rice(Oryza sativa)
  misc_feature (71): n=t or c
ttgtccaacatttccctaacttgctgttcaatctcgtctttttgagccggtgtataccgataggggcgcanattgacaggcactgcaccagggataagagg

SEQ ID NO: 55087 - DNA, 101 bp, rice(Oryza sativa)
  misc_feature (71): n=a or g
agctagaagctctggaggcaataaaaagggtgttggagtctgagattgagtctgcacatcaggataacagnaagctcaatgataaggtgaagtcttttgag

SEQ ID NO: 55088 - DNA, 101 bp, rice(Oryza sativa)
  misc_feature (71): n=t or c
gggttcgagagccactcggagaattggacctcccgaatgacccctgcttcgagcaatttcttcacctcctnacgggctgcttgggcccgctcgactgacat

SEQ ID NO: 55089 - DNA, 101 bp, rice(Oryza sativa)
  misc_feature (71): n=t or c
cagtcaagtccaatctagctaaggctcaggctcgcatgaaatattttgctgatcaacatcgccaagaacgnacattggaggttgtgatatggtttacctta

SEQ ID NO: 55090 - DNA, 101 bp, rice(Oryza sativa)
  misc_feature (71): n=t or c
atcaaggtttaaagtttatgaaattagcgaaaaggaaggcatatagtatgtcacaaaactaaagatttaangttaattttatcacgaaattatagcttttg

SEQ ID NO: 55091 - DNA, 101 bp, rice(Oryza sativa)
  misc_feature (71): n=t or c
gacgacgacgacgactcttaatttacaaacacgtagcctagctagctcgtaaataacaccagcgtcacggntttgcatgcaagcgatcgaggtatcagctg

SEQ ID NO: 55092 - DNA, 101 bp, rice(Oryza sativa)
  misc_feature (71): n=a or c
aatatgtaaaacatatttattatttgctcacataataactttgttatgtcatgatttatcttctagctatntacctagcactagcagcagaaaagaaaagg

SEQ ID NO: 55093 - DNA, 101 bp, rice(Oryza sativa)
  misc_feature (71): n=t or c
tttttaacacatctcgtattgcagattagcagtttaagaaaaacgtgcttacggtaaactcactctcaaantcaaagctcgagggcttgatgcttgagggc

SEQ ID NO: 55094 - DNA, 101 bp, rice(Oryza sativa)
  misc_feature (71): n=a or g
gccgccattgcctctggtgtacatccccctaggtctagtttccacgcctagtagagtgatgatgttgaagnctggtgtagctttccctgaccgaagccccc

SEQ ID NO: 55095 - DNA, 101 bp, rice(Oryza sativa)
  misc_feature (71): n=a or g
tattaggttgttagataaaaaatataaggcgagagatcaaaggaagtatatgtatagcaggacgagagacngagattttttttctgagacatattccaacg

SEQ ID NO: 55096 - DNA, 101 bp, rice(Oryza sativa)
  misc_feature (71): n=t or c
atctaattaaattatccaaaaaataacatggtgcctattgtgtcaacaatacttgcagaacattcaattangtcaggtggcagaacgagatgccgcgattg

SEQ ID NO: 55097 - DNA, 101 bp, rice(Oryza sativa)
  misc_feature (71): n=t or c
caaccttcgcgaacatgtagacgaccggcagagggaacgacgaaatcggaatgacactgactgtcatcggngtcgttctccctctcgacaaggagggaaca

SEQ ID NO: 55098 - DNA, 101 bp, rice(Oryza sativa)
  misc_feature (71): n=a or c
tgcggtggtctgtttggaagacaagaaataaagcttgttttgagcggttgttgccataggaccccactganattttatatcaagcgtgctcatggatgcat

SEQ ID NO: 55099 - DNA, 101 bp, rice(Oryza sativa)
  misc_feature (71): n=a or g
aattctgtagtagtggtaatgactgcacatatacagaactagctctcaaaccaaccactccacgaatcatnacagctaatctatgtaatctggtgtgcatg

SEQ ID NO: 55100 - DNA, 101 bp, rice(Oryza sativa)
  misc_feature (71): n=t or g
tacgcattggatgtcttgttctacatattgcatgtctatatcgttcgctactgtgtgccgaattggtcaanaacagtataatccacgtctggccctgtcca

SEQ ID NO: 55101 - DNA, 101 bp, rice(Oryza sativa)
  misc_feature (71): n=t or c
ccgccggtaaccattaccgtacccccacggtaagagtggttacggcagtaagggaagccctgcttatgacncatcaaagatatttatgacccgtcatcgta

SEQ ID NO: 55102 - DNA, 101 bp, rice(Oryza sativa)
  misc_feature (71): n=a or g
aaacttcaatcttggttttgatagctctcaggaagttgtgcaaacaccaaaggggcaagaagcaacaggancatctcgaggtaaagaatttcctagaatta

SEQ ID NO: 55103 - DNA, 101 bp, rice(Oryza sativa)
  misc_feature (71): n=t or c
gaggtagagaaaaggatgaggctggatgtttctggatccttcttcgtgtaccagatgagcacgttagaagnaggaataccattatcatcgtatggtataga

SEQ ID NO: 55104 - DNA, 101 bp, rice(Oryza sativa)
  misc_feature (71): n=a or g
atgttcaagtagacgtggctacaaaagccaacgcccaagcttttaacaatggtcttatcagtcgtgcactnttcggagccaccggtatgcctgatgtctcc

SEQ ID NO: 55105 - DNA, 101 bp, rice(Oryza sativa)
  misc_feature (71): n=t or g
gcatcttgtcctaggtaatgcctttaccagttaatggctctgttaaaggttgatgacagcgctgcatcatnaggtgaaattttagttccatattttttccc

SEQ ID NO: 55106 - DNA, 101 bp, rice(Oryza sativa)
  misc_feature (71): n=t or g
ttggcgtttattcggttggcaacctatacacgcgaatgaatagataacaatcttagtgatgacttaggcancgttcgagagggtgagagagtgagtttgtt

SEQ ID NO: 55107 - DNA, 101 bp, rice(Oryza sativa)
  misc_feature (71): n=a or g
aacacacatgccgtaaagaaccacacttcacagtgcacaatacatgtttgtgggtcccacccatgttagtnggtcccaccatctctcttttcacattcatc

SEQ ID NO: 55108 - DNA, 101 bp, rice(Oryza sativa)
  misc_feature (71): n=a or g
tgtgctacattgggttttgtgatctatgggcctgtacacatcagtttatggctttgtgctatcacaaatgnttagatgggtttcagcttatccaatttcct

SEQ ID NO: 55109 - DNA, 101 bp, rice(Oryza sativa)
  misc_feature (71): n=a or c
aacagaattgtcaaagttgcttgtagtaataaaaataattagaaattttgactatttgagtttctcatggngagcagggaaggaaggaaattctttcatta

SEQ ID NO: 55110 - DNA, 101 bp, rice(Oryza sativa)
  misc_feature (71): n=t or c
gtattcaaattttgaccatcatccattagtaagttcacaaatattccaaataatacaccctccatggctcngtcctactcactaagatgggtacgcataaa

SEQ ID NO: 55111 - DNA, 101 bp, rice(Oryza sativa)
  misc_feature (71): n=a or c
aatgagcctcctgtggtattcttattttttttcataaaaagacaattgaccatgcaattgtaatgataagntctgtaccacctgataagctttgagcttcc

SEQ ID NO: 55112 - DNA, 101 bp, rice(Oryza sativa)
  misc_feature (71): n=a or g
tattaggaaaatgcatgcctaagacgaattcccaaaagagcattagtctccactatgaaaccggtcattcntaatgggttataaccctcatctgtgtcggc

SEQ ID NO: 55113 - DNA, 101 bp, rice(Oryza sativa)
  misc_feature (71): n=t or c
acatttgttaagataagcagaatgacagaaagctgaaaccttgaaaggtggcctttctcactgcgaccttntcccttgaattgtgccattgcagctaagtt

SEQ ID NO: 55114 - DNA, 101 bp, rice(Oryza sativa)
  misc_feature (71): n=a or g
atggtggcaggtgttacgttgatgcaggctgggagaatgaattaactcgagttggaatcttgcttcatatnccttagagcaaggataataatacatttgac

SEQ ID NO: 55115 - DNA, 101 bp, rice(Oryza sativa)
  misc_feature (71): n=a or g
cccaaaaaagaaacccagaattcaaaccaacaaaaagtttgcccaaaaatccccaaactttccaaaggccnatccacactacacagtgccatgtaccggta

SEQ ID NO: 55116 - DNA, 101 bp, rice(Oryza sativa)
  misc_feature (71): n=a or g
tcagttaaccaacatatttcaacaggttgacagaatctcacgcaacagtcttctaattggctacactattngtgcacgatacattgcgtaatggtgctaca

SEQ ID NO: 55117 - DNA, 101 bp, rice(Oryza sativa)
  misc_feature (71): n=t or g
gctttcctccgtagccgccccctcctctatcaaaagaggaagaagagataaaagtgaaaaatgtggaagangaagatgacatgtgggccgcatatgagcgt

SEQ ID NO: 55118 - DNA, 101 bp, rice(Oryza sativa)
  misc_feature (71): n=a or g
ctctcttgaactttgatcttgttgtgtccctgaatgaggggggaggggagaattcggtgaagtgtgaaagnatatacttcagcacatttagccaagttgtt

SEQ ID NO: 55119 - DNA, 101 bp, rice(Oryza sativa)
  misc_feature (71): n=t or c
cgtccgccaacaccgggtgcatgcacatcgctgtcgatgctggcgtcgtcgtcggtgaaaccgaggaacgngtcatcatggttgccgatggcggccggggc

SEQ ID NO: 55120 - DNA, 101 bp, rice(Oryza sativa)
  misc_feature (71): n=a or g
tcgaagagacggaagcaaaggtaaaggctcggccagagaggaggaccatggagaaatggtgtcactcacanaaatttaacccaaattttaaatccatatcc

SEQ ID NO: 55121 - DNA, 101 bp, rice(Oryza sativa)
  misc_feature (71): n=a or g
ctcaaccaatcttcacacaatttgatcagattaaaatgctctaagtgaggaaaaaaactcaccaagcttantgctaatcctaccacatttgaaactccaat

SEQ ID NO: 55122 - DNA, 101 bp, rice(Oryza sativa)
  misc_feature (71): n=t or c
ttctccaccaggtgtggtgcttgtcttttgtgttcatgtgtgattcaagtgattcttgtttggtcggtctntgcctttttgttctagagagatctcctggt

SEQ ID NO: 55123 - DNA, 101 bp, rice(Oryza sativa)
  misc_feature (71): n=t or c
tctttcaaaattcaagtttctatgtaatgaataatctatagagatttttaaggaatggtagcaagagctcnaacatcttagaaattttcattcaagtctat

SEQ ID NO: 55124 - DNA, 101 bp, rice(Oryza sativa)
  misc_feature (71): n=t or c
agctgttgcatcatacctatgcggtctagatgagttaaaaataaaaccgctcccatgctatatcaccattngtgcgactataacctatctcttctctttgt

SEQ ID NO: 55125 - DNA, 101 bp, rice(Oryza sativa)
  misc_feature (71): n=t or c
ttgacacgaattcgacacgaattacgcaaggctgtgttctttcccatcacttcgctcatctccttcgtttncctcgtacaagcttttcaaattgctaaatg

SEQ ID NO: 55126 - DNA, 101 bp, rice(Oryza sativa)
  misc_feature (71): n=a or g
gcgaatcgagtctactttgtttagtgaaaccgatgcgaattgaaacatagttttgtttagtgacgtgatgngagctgttttagctaatgcaacgttaagtg

SEQ ID NO: 55127 - DNA, 101 bp, rice(Oryza sativa)
  misc_feature (71): n=a or c
aagaagataatgcatcaaaagtaatgtaactaacacaagcacactcatcaaatctactcctaaaaacctanaccttttttccctaaaagtccatgcaacca

SEQ ID NO: 55128 - DNA, 101 bp, rice(Oryza sativa)
  misc_feature (71): n=a or g
attcatatacacatcatatataatctgtgagatgacatttttcctgtcaatgacagcttgcaggaaggttnagattgattctgaattgttgccaagctgca

SEQ ID NO: 55129 - DNA, 101 bp, rice(Oryza sativa)
  misc_feature (71): n=a or c
ctcggcatcaacacctgccttggtaactacaaagatcaagctatggggatataaaggaaaccaagtcatgnatgctatatacatacgtaactccgtttcca

SEQ ID NO: 55130 - DNA, 101 bp, rice(Oryza sativa)
  misc_feature (71): n=a or g
gggtgcttcatcgtcgagctcctcctccagtggagagagggagaccatgcccatgtcgacaatcacatgcngttgatgtcgaacagcatatactacgacct

SEQ ID NO: 55131 - DNA, 101 bp, rice(Oryza sativa)
  misc_feature (71): n=t or c
accgctcgttttcccgaatggctatgtttatagcaccaaggtaaaaactacgagctgaaccaggtcattanggtattatgccgatctgcgagttcatactt

SEQ ID NO: 55132 - DNA, 101 bp, rice(Oryza sativa)
  misc_feature (71): n=a or g
actcactatgagatgggacgttttctagaactacaaatctgaatctggacatgtaagctgaatctggacancacaatataggctgcctatccaggttagta

SEQ ID NO: 55133 - DNA, 101 bp, rice(Oryza sativa)
  misc_feature (71): n=a or g
aagaaatcaaacatgcatttggcatgcaataaaaattcagcagtgaactatgaacaactgagaagatactnttgaatagtctcacattggttgtgaaagga

SEQ ID NO: 55134 - DNA, 101 bp, rice(Oryza sativa)
  misc_feature (71): n=t or c
ttcatattcttcaccgtagcctaatcgatcaaaagcgcaatgcaagtagcgggccgagtttagttctaaantttttctttaaactttctacttttctatca

SEQ ID NO: 55135 - DNA, 101 bp, rice(Oryza sativa)
  misc_feature (71): n=t or c
atgtgtgatattttttacctcgatctctgcccaatctagttttggcatatgtgctcaggagggatttaggntttgtttggcaaatgtgattggaaaataat

SEQ ID NO: 55136 - DNA, 101 bp, rice(Oryza sativa)
  misc_feature (71): n=t or g
aagcattaagcataatggcactacagttgcaaagtgttacagctgattttggaaaggcaagaagcagtctnaacggaacgttcgaacggaggcaacctggc

SEQ ID NO: 55137 - DNA, 101 bp, rice(Oryza sativa)
  misc_feature (71): n=a or c
caataattgcagaaattttatcctctttgtcagatctaaactgccctccttgaggtgcattgcacatttgnagtagtagcagtagtaaggcctggtttagc

SEQ ID NO: 55138 - DNA, 101 bp, rice(Oryza sativa)
  misc_feature (71): n=a or g
tcaccgaccgccgctgcggatggcctccacctataccgccgtatgctccgccaccgcgtcgcccctaacanctacaccttccccttcgccctcaaggcctg

SEQ ID NO: 55139 - DNA, 101 bp, rice(Oryza sativa)
  misc_feature (71): n=t or g
tctctcacgtgtgagcctggcctgccgcgtgcaactactatggaaggccatttgagacattttttatcacngtttgtttttctatagaattcacgtcgtcc

SEQ ID NO: 55140 - DNA, 101 bp, rice(Oryza sativa)
  misc_feature (71): n=t or c
tttgtaacacgaatcttggaacacatcaacggtgtagattgcaggcccgagtgcaaatctgcatacaagtnttctcatgtacacaccgtataaaccaacta

SEQ ID NO: 55141 - DNA, 101 bp, rice(Oryza sativa)
  misc_feature (71): n=t or c
ggggcagcagtagagatggtaccccatgacccaagacctgatgagcttttacactattatgagtcacatanagagatggtaatagggccctgtttaccttt

SEQ ID NO: 55142 - DNA, 101 bp, rice(Oryza sativa)
  misc_feature (71): n=t or g
gtgatatacgtacagattattgtcgttgcacagtttgatgaagttggtgaattaatttgaggctccctttngactatatcttagcacaaatatacaactcc

SEQ ID NO: 55143 - DNA, 101 bp, rice(Oryza sativa)
  misc_feature (71): n=t or c
ggtgaggtaacgtcctgccctatctgtaaacataccaaatgccatgtggtacaaggttaacggggatattngttaacggacactgaaaacgcgtacaaatg

SEQ ID NO: 55144 - DNA, 101 bp, rice(Oryza sativa)
  misc_feature (71): n=a or g
gtgccggccttctcactcgcagatccagtggtgccggccttctctctcgtggatccataggccctagcccnaggaggggcggatccatcgccaccggcctc

SEQ ID NO: 55145 - DNA, 101 bp, rice(Oryza sativa)
  misc_feature (71): n=a or g
ccggttagatgatttatacgcacggcacactcacacattcacaaatacgtattctaacatatactctaagnaaataacaaccaataataaatctgagctta

SEQ ID NO: 55146 - DNA, 101 bp, rice(Oryza sativa)
  misc_feature (71): n=a or g
tggcccagtcaatcttttcacttgtgtaagcatcgtcagagttctttgccgtactacctgcaacagctttnttctgagatgcagaggctttccttgatggc

SEQ ID NO: 55147 - DNA, 101 bp, rice(Oryza sativa)
  misc_feature (71): n=a or c
aattttagcagttccgtatacttttttattaatagccatccacggttgttgcgagctgcctttgtgcctanccaaaaattcaacacgaaacccaatagcca

SEQ ID NO: 55148 - DNA, 101 bp, rice(Oryza sativa)
  misc_feature (71): n=t or c
ggaaggaaaagttggttccttttaagggtagagtttgcttggtagtagctcctccattcacatgaggaaancactaatcgtgcaagatcaatgaaaatacc

SEQ ID NO: 55149 - DNA, 101 bp, rice(Oryza sativa)
  misc_feature (71): n=a or g
acatattgtatgtatatacgggtgtatctgtgacatgtaggtatataaaggcgcgaagcaactacaaatcngacgccctatttgtttttcattgtttttca

SEQ ID NO: 55150 - DNA, 101 bp, rice(Oryza sativa)
  misc_feature (71): n=a or g
gccgggagctcagtgagtatccaagtgctgttctcctcaatggatttgatttcatcttgcatcgcttgccnccaatgttcatcctgctctgcttcagtgag

SEQ ID NO: 55151 - DNA, 101 bp, rice(Oryza sativa)
  misc_feature (71): n=a or g
ggaggcaacaatggggaagacgaaggggaagcagcgacaggataagttctaccacctcgccaagaagcagngctaccagagtcgcgcggccttcaagctgc

SEQ ID NO: 55152 - DNA, 101 bp, rice(Oryza sativa)
  misc_feature (71): n=a or g
aatctaaggataaggataattcatgtactgagagaaagacataggaagaaaatcaggagagagaaaaggtncggactgagagggggtggtgggaaacgtgc

SEQ ID NO: 55153 - DNA, 101 bp, rice(Oryza sativa)
  misc_feature (71): n=t or c
ctcagctctcaccttggtaacatttcttttctcttcatcctcaacctcaccaacaccggcctcgctggctnggtgccgaacgaaataggaaggctgcatcg

SEQ ID NO: 55154 - DNA, 101 bp, rice(Oryza sativa)
  misc_feature (71): n=a or g
acgccctctcttatgaaccttcattaattgacctattaggaggtgcgctgacataagcaaaatggcgtcantaatgacgatcaaatacaaacgtaagcatg

SEQ ID NO: 55155 - DNA, 101 bp, rice(Oryza sativa)
  misc_feature (71): n=a or g
tcactaataatcaagcttagcgacatccatttatatgttgttcctttaagtgacttcacctaattacaatntcatcatgcaagatattatagatgagacta

SEQ ID NO: 55156 - DNA, 101 bp, rice(Oryza sativa)
  misc_feature (71): n=a or g
gacagagggagggagaggggtccggtccttcctccctagtactataggtatagtttagtcggggtttcttngttggttggggtcctcccgttgtgtagttc

SEQ ID NO: 55157 - DNA, 101 bp, rice(Oryza sativa)
  misc_feature (71): n=a or g
tgattttttaaaacaacttatgcatctacttactcatcccaacgagtcacaaacatcactcgattaatttntttagatagtttctcatctcaaccaatcat

SEQ ID NO: 55158 - DNA, 101 bp, rice(Oryza sativa)
  misc_feature (71): n=a or c
atgagaaaatcatactgtttttcatccgtatcaactgatggtttcgatcgaccaaaaaagacaagaagtantggagtttgaaggacgctggagggtgccaa

SEQ ID NO: 55159 - DNA, 101 bp, rice(Oryza sativa)
  misc_feature (71): n=t or g
atgtttttcacataggattactgcgcttgtatgttaagatggctatatattggttgacatgcaacggcttnaaatgacttgtacataacaattacttctca

SEQ ID NO: 55160 - DNA, 101 bp, rice(Oryza sativa)
  misc_feature (71): n=a or g
gagcgtgagcatgggagaagagaaaaaaaaacatctttttaagtctcatccctatcctcccaacgctatcntcatcaatatccaattcttctctctcgttc

SEQ ID NO: 55161 - DNA, 101 bp, rice(Oryza sativa)
  misc_feature (71): n=t or c
cattgatgtcagaaattcataatctttcctttttaaacagagccaatatcgggtgcttatggagtgtggcngctggaatgcggacccgtgccaccaccgtc

SEQ ID NO: 55162 - DNA, 101 bp, rice(Oryza sativa)
  misc_feature (71): n=t or c
attatgcatgcaatgtcagtttggactggaatcggtcgtacattaattactccttccgtctctctccgttntaaaataaacacataatatgatatatttag

SEQ ID NO: 55163 - DNA, 101 bp, rice(Oryza sativa)
  misc_feature (71): n=a or c
tgggccgcccatattagccattatccaccagaccataagaagcccataaaattaattaagtactccagtcnagtcatgagacaatcaatcgttgttccatc

SEQ ID NO: 55164 - DNA, 101 bp, rice(Oryza sativa)
  misc_feature (71): n=t or c
tgttttcttacttgaaggttcttcatgacctccctaatggcaaaagtttctatcgccatagatcaaaaggntcatggactctttctacagcagacaatggt

SEQ ID NO: 55165 - DNA, 101 bp, rice(Oryza sativa)
  misc_feature (71): n=a or g
gtcttgctccttgtgagttgtgaggtaactaatgagaaaagggtttgtctaactaaagagtgacccacaanccattactttctatacaatttttcaacctc

SEQ ID NO: 55166 - DNA, 101 bp, rice(Oryza sativa)
  misc_feature (71): n=a or g
taccgtcacctcacggtttgacggttatcacggtaaccgcgaaaaccacacggttatcgtgaagtataccntggctttaaaaactgaaaagattatcacat

SEQ ID NO: 55167 - DNA, 101 bp, rice(Oryza sativa)
  misc_feature (71): n=t or c
aatctgtttttaaatcgagggatgtctcatgtgtttagcctgtactcccatttaatttagcgacgataagnatcgatgcccgcctctcctatctggaatat

SEQ ID NO: 55168 - DNA, 101 bp, rice(Oryza sativa)
  misc_feature (71): n=t or g
cacggcgaggacgcagaggcatccttggcgccgaagccgtgactgagctggtggtggtggtggtgctgctncctagcgtcgccgccgccgccgccatggcg

SEQ ID NO: 55169 - DNA, 101 bp, rice(Oryza sativa)
  misc_feature (71): n=a or g
gccaggtaggtgtcggccacaatggcgtccggcctccacttctgctccagcaacagccggtcaagcagccnctcgacggccgccgccatcctggtgtgcac

SEQ ID NO: 55170 - DNA, 101 bp, rice(Oryza sativa)
  misc_feature (71): n=a or g
tggagagagtagtatttgtaagtatacgagaccaggtttttgtttagtacggaggcctgaaattatgggtncatctagcacggcactggtgtggttaggcc

SEQ ID NO: 55171 - DNA, 101 bp, rice(Oryza sativa)
  misc_feature (71): n=t or c
cgatgaatccaaagtcatatttgagagaggagatttgtgatagtggcccaaatcctaaggagatgaatgcntcgcgtgtcacagagctgcacaaatcagtt

SEQ ID NO: 55172 - DNA, 101 bp, rice(Oryza sativa)
  misc_feature (71): n=a or c
cgaattgatcatggtggaccttcctgaggaacttcactacccacaatactttctcccacctggcctacagnttgaggaacatttgtcccgtgcctcaagag

SEQ ID NO: 55173 - DNA, 101 bp, rice(Oryza sativa)
  misc_feature (71): n=t or c
cgcgtagtggtgggcaaaacgataagagtacaagatacagagtatacaaatacaaccctctttaaacctancgtgatgactaaaagcctaaaatcattaat

SEQ ID NO: 55174 - DNA, 101 bp, rice(Oryza sativa)
  misc_feature (71): n=a or g
aaaaagttcttttataaccatctacattcatgttctgagtgcgtggttaaaagtgtcaaatactccctctnttccattttaagtgcagctatggttttccg

SEQ ID NO: 55175 - DNA, 101 bp, rice(Oryza sativa)
  misc_feature (71): n=a or g
tatattatgaaacgttaaaaaaaatagttgtgcattatactccgtctgtcctgtaatgtttgtcgtttctnacaggcttgtgaaaattaaggaagctatga

SEQ ID NO: 55176 - DNA, 101 bp, rice(Oryza sativa)
  misc_feature (71): n=t or c
aacctcccttcaaatatgtgtgctacaccaccgttattgtgatgtatgtggtgcctccagttcaagagttngaatactaactcaatcctcaccattattat

SEQ ID NO: 55177 - DNA, 101 bp, rice(Oryza sativa)
  misc_feature (71): n=t or c
tcggcttgccctaggcttgcctccacccttgaaaacacacgtacatgtaagtaaatgtaacatgtacaaangatgctacaagtagttaactctggactaat

SEQ ID NO: 55178 - DNA, 101 bp, rice(Oryza sativa)
  misc_feature (71): n=t or c
agacaaactctagctatgaatatggacacgtatgtgtctagattcgtaattaggatttgaccttttttaanggaggagataggctacaacaatggtgtgca

SEQ ID NO: 55179 - DNA, 101 bp, rice(Oryza sativa)
  misc_feature (71): n=a or g
gttgtttctaatttatatataagacggtccacttccggtagctcgaatttattttatcggccgctaggctnaaaccgtattttctagattcaagtttggtg

SEQ ID NO: 55180 - DNA, 101 bp, rice(Oryza sativa)
  misc_feature (71): n=t or c
ttaaaaatatttatatttatgaatgaaggacatacatataaaatgattatgagcagggccggccctgaggnagtgcgggcggtacgaccacactgggcctc

SEQ ID NO: 55181 - DNA, 101 bp, rice(Oryza sativa)
  misc_feature (71): n=t or g
cgaggatcaaatgtgtcatatgttctgctaagaatacttggtacatgcgtgcgcgtgggttgcacatgcanatatgtatgcacaccgcacacgctttaaac

SEQ ID NO: 55182 - DNA, 101 bp, rice(Oryza sativa)
  misc_feature (71): n=t or c
tttttataggccggcttaggaagtgatgggccgcattattaattttaatcccgcatttattttttttattnccagaaattcatttatgagctttcatagcc

SEQ ID NO: 55183 - DNA, 101 bp, rice(Oryza sativa)
  misc_feature (71): n=t or c
atcatttgatactcttcttcatcctgcacacacaagcaaatgacacataagaatactcaagaacaggtcangttagcaaaaacatgttagttgtctgagag

SEQ ID NO: 55184 - DNA, 101 bp, rice(Oryza sativa)
  misc_feature (71): n=a or g
actactacaaaccaagaacaccctcagcaagaaccattaatcttcagtggcacaaacaattaatacctccntcccaaaatacttgtcgctttgagtttttg

SEQ ID NO: 55185 - DNA, 101 bp, rice(Oryza sativa)
  misc_feature (71): n=a or g
ttgcggctgtacagttgtacgtggggaggccatatgtgtggatcctgtgcataatcaccccgttgaatccncccccttcgtttctcgaaagaaatttgaaa

SEQ ID NO: 55186 - DNA, 101 bp, rice(Oryza sativa)
  misc_feature (71): n=t or c
ggaagttcttgaacaccaccttcttgatgtgtgccttgaggcattcaacaggggcaacatcctgccagaanttcaacttgaagttgagcttgccagtgggt

SEQ ID NO: 55187 - DNA, 101 bp, rice(Oryza sativa)
  misc_feature (71): n=a or g
caaaatataccttctctaattgccctggtgtaatctgctagctttgagcttaccgggagaatacttggggncggaaaatggagctggggcttgagccccaa

SEQ ID NO: 55188 - DNA, 101 bp, rice(Oryza sativa)
  misc_feature (71): n=a or g
agttgtgatagagtgacctgtccattgtgaattgggtaagaaaaatcggaactcggcggaaatcattgctncaaccctttggttgaaccatccaaacgtcg

SEQ ID NO: 55189 - DNA, 101 bp, rice(Oryza sativa)
  misc_feature (71): n=t or c
tgatttgttgtgaatcattttgttgtttagcagcgattagatctgacttctagaacgatgaaaacacacanccttgagtagagcacatacatgttttatgt

SEQ ID NO: 55190 - DNA, 101 bp, rice(Oryza sativa)
  misc_feature (71): n=t or c
tcgtatattttaaaatgaagggagtatgtatgatatgataacagaggtctctttgtcctcgagctcaaatngaggctatgttcgtctctaacgatgaagaa

SEQ ID NO: 55191 - DNA, 101 bp, rice(Oryza sativa)
  misc_feature (71): n=a or g
aatcagtttggtgagaattgtgatattccacgcagaaaaggactggcagttagtagcagtgtagcacaaanccacatactttaacctgtacagttcatgtg

SEQ ID NO: 55192 - DNA, 101 bp, rice(Oryza sativa)
  misc_feature (71): n=t or c
gatcgcgtgcgtactctctcctccttgaactcggtctgctttaagaaaagaaaagtagataggctaagccnaaaacgaaaataactgtaggcccaagaaca

SEQ ID NO: 55193 - DNA, 101 bp, rice(Oryza sativa)
  misc_feature (71): n=t or c
ctgctcgacgacggcggggcgctgcttcgccttccccggcgcgttgttgatgatctgtatcttcctctgcntcttcgccgtctcttcctctgtgtaacgct

SEQ ID NO: 55194 - DNA, 101 bp, rice(Oryza sativa)
  misc_feature (71): n=a or c
ctttatttcactttggaccacccgacttgacatcttctcaagcgtatgaatgatttcgattacgtcggctnttgctcatcaatgaactcccacaattatat

SEQ ID NO: 55195 - DNA, 101 bp, rice(Oryza sativa)
  misc_feature (71): n=t or c
tagttgggaagtcttcgcccagttcatcacatgcaccacctgtcaaactactattacagtacacaccgatngatcacatattacagattccatcacacact

SEQ ID NO: 55196 - DNA, 101 bp, rice(Oryza sativa)
  misc_feature (71): n=t or c
ttcttttgttttcattgtttggcgctagagaatcgaacacaacagaaaatagtgaacatatgctccagtanaattgtgtgttatttcatctttaacataaa

SEQ ID NO: 55197 - DNA, 101 bp, rice(Oryza sativa)
  misc_feature (71): n=t or c
tctaataaacatattttttgtgattagacagaagacgcacatacacaccacactcacaaacccataggtanatctcctatcactcatagagatggagacca

SEQ ID NO: 55198 - DNA, 101 bp, rice(Oryza sativa)
  misc_feature (71): n=a or g
gggtctcaagaatccatctggatcagcaactaaatccatttgaagttaatactatcgggaggttcgaatcnaatccaaaatatgcagaacttaatcttttg

SEQ ID NO: 55199 - DNA, 101 bp, rice(Oryza sativa)
  misc_feature (71): n=a or g
tgggctcgcatcgccccgacatgaggaaatgatactagagtgtggagaaagcaagagaaaggaaagagagngggagaaaagaagagaggacactaacacat

SEQ ID NO: 55200 - DNA, 101 bp, rice(Oryza sativa)
  misc_feature (71): n=t or g
taccaaaaatcataaaaagaaatggtataatgacgcatagctccaatgccacgggtaattcatcacagaangtcacatgtgtagttgtgctgagctagaaa

SEQ ID NO: 55201 - DNA, 101 bp, rice(Oryza sativa)
  misc_feature (71): n=a or g
tggaatgatttttacatgattgtagttctaaatctagggatccgatgttcggatgacgagaagaaatttgngattacacctttagatatggatttaactct

SEQ ID NO: 55202 - DNA, 101 bp, rice(Oryza sativa)
  misc_feature (71): n=t or c
ttcggtctgattttgattgaactaggctgacgaaaacacatcgatcatgtagtcgaccagattggtccagncaaatttgtgcaatgacgtcggtgcgaaag

SEQ ID NO: 55203 - DNA, 101 bp, rice(Oryza sativa)
  misc_feature (71): n=a or g
aacatgaagaggatcgatgtggtaaagagctgaaccttcccgaactgatccataagaacattatccaactnttgggtttctgctgtaagctggatgctgta

SEQ ID NO: 55204 - DNA, 101 bp, rice(Oryza sativa)
  misc_feature (71): n=t or c
tttggcaattttacaacgttgccaaaattttggtagaattggtttcataatgttgccaaaactctatacanattgccaatatttgataacaaactaaacgt

SEQ ID NO: 55205 - DNA, 101 bp, rice(Oryza sativa)
  misc_feature (71): n=a or g
ctagccaccagatttggccttgccgaactcttcattgttgtctcttggagaaccagtgtccataatcatcnccatccttttagctcagatttaataccctt

SEQ ID NO: 55206 - DNA, 101 bp, rice(Oryza sativa)
  misc_feature (71): n=t or g
aaaggtaattacttcctgtaattagagggtgtatttaacagcaataaatatcatgcaaagcttgcacccgnattttgcatatcaatgatttgttcgggttt

SEQ ID NO: 55207 - DNA, 101 bp, rice(Oryza sativa)
  misc_feature (71): n=t or c
ctatcagtggcctgcatgccaagtgcgtgcccggttcctggtattgtggtctgcgaggcagctaccatctngaatagcgggcgctcaccatcggccaagga

SEQ ID NO: 55208 - DNA, 101 bp, rice(Oryza sativa)
  misc_feature (71): n=a or g
aatctattggaccccttcgccgacgagagagatcaaggaaggaagaagcggatgaatgaaggagcaatttngtccttcaaaaggatagaaaatgcagcgaa

SEQ ID NO: 55209 - DNA, 101 bp, rice(Oryza sativa)
  misc_feature (71): n=a or g
gttgagccctaattttagaagatggcctacatatgttgtttggctttagaaatagggatgggtaaccattngcctactcttagttcaagtaaatcaacaga

SEQ ID NO: 55210 - DNA, 101 bp, rice(Oryza sativa)
  misc_feature (71): n=a or c
agagcaatatttctgtccttattttgtttagagagagcaagagatattttctgttcctctcctgtccccanacaccaggggtctccctctctcctctcctc

SEQ ID NO: 55211 - DNA, 101 bp, rice(Oryza sativa)
  misc_feature (71): n=a or c
acccccgcgtcgccagtcgccactgccattcaaagctcgcacccgctcgcgagagaagaagagagaaaagngaggagagagagaggcaaacccgcaccaaa

SEQ ID NO: 55212 - DNA, 101 bp, rice(Oryza sativa)
  misc_feature (71): n=a or g
tcaggtatacagtttcgacaccattttcactgtaaccgtccatatatggttatgatattaatatagaatcntgaaattatgtttcacttattgttatttgg

SEQ ID NO: 55213 - DNA, 101 bp, rice(Oryza sativa)
  misc_feature (71): n=a or g
gcttctagaggcaacatgacatgtggagctgttagaggcaagcttcagcaagggagggagaaaagagaggngcgaggattaacgaagaagggcaatatgac

SEQ ID NO: 55214 - DNA, 101 bp, rice(Oryza sativa)
  misc_feature (71): n=t or g
agggagcagtctccttgatcctccattctgcctcagatgggatgttcgtgaactgctttatcctctcaacngagaccattttgttttcaatattgcaactc

SEQ ID NO: 55215 - DNA, 101 bp, rice(Oryza sativa)
  misc_feature (71): n=a or g
gtcacgcatatgttttcagactttcagcattactctttccgttccatataaagtaaatctagaaccgaatntaatacattttaatactataaatctagaca

SEQ ID NO: 55216 - DNA, 101 bp, rice(Oryza sativa)
  misc_feature (71): n=t or c
ctgcacagatgtacttagaagtacctaggtagaatctggatagactcatatgtgccgggtattctctaaantcgacactgatgtgggcacatctgtgctgg

SEQ ID NO: 55217 - DNA, 101 bp, rice(Oryza sativa)
  misc_feature (71): n=t or c
agttgttttccctgtagcaaatgtgatgctcgtcctgcagctctatcagtttgctttacgttaaaagaganaagaaagagcaatttgctctgcgaattgcg

SEQ ID NO: 55218 - DNA, 101 bp, rice(Oryza sativa)
  misc_feature (71): n=t or c
cgcatagtagtagccatagtcgatacagcaaaagattagcatgagcctcacttcaggagacatatacagantaaaaattgggcaaggaagcaaataattca

SEQ ID NO: 55219 - DNA, 101 bp, rice(Oryza sativa)
  misc_feature (71): n=a or g
atgacgtcatcaattaaaaaaaacacgtacattaccgatgaacttaatacattcgacgtttgtaataaacntctcgataaagtgaatctgaaactgtttgg

SEQ ID NO: 55220 - DNA, 101 bp, rice(Oryza sativa)
  misc_feature (71): n=a or g
ccccggtaatcatcccatgtcggtggtttttttttaggaactagcaagctgccaattttcattgaggcctntttagttcccacgcaaaaacttttcacctt

SEQ ID NO: 55221 - DNA, 101 bp, rice(Oryza sativa)
  misc_feature (71): n=t or c
catcggaggttcctcaggcaggatcacccataccaccgaaataaaaatgcttttgatgggacggtagaaanggatggatgtccaattttcagaaccggaag

SEQ ID NO: 55222 - DNA, 101 bp, rice(Oryza sativa)
  misc_feature (71): n=a or c
atctcctaattattcattcctgtatgacactggttagtaagataacaccgaattggagcaatggatggcanagtacaaactgcagagacctcatagtaacc

SEQ ID NO: 55223 - DNA, 101 bp, rice(Oryza sativa)
  misc_feature (71): n=a or g
aaaattcccggaccagattggatcagctggaatctaatctaccaccactgaacaacactgatggatggatncttcccccgcattatctttttccacacctt

SEQ ID NO: 55224 - DNA, 101 bp, rice(Oryza sativa)
  misc_feature (71): n=t or c
tacatcgccgacgcctacatgggattgatgcgagttggtccaaaaggcggggaggcaaccgtgctagccangaaggctgatggcgtgccacttcgcttcac

SEQ ID NO: 55225 - DNA, 101 bp, rice(Oryza sativa)
  misc_feature (71): n=a or g
aaacttcagggcgtgacacacctcccagtcgccactctatgtctgactctctctctctcattttctcaacngcgttagcggcgccgtcaccatctcgtccc

SEQ ID NO: 55226 - DNA, 101 bp, rice(Oryza sativa)
  misc_feature (71): n=t or c
aatatcacgtctctatattatccgatttccatagcaattttacactatagggaatgggagggaatatcccnttttttaaggactagtccaattataaatat

SEQ ID NO: 55227 - DNA, 101 bp, rice(Oryza sativa)
  misc_feature (71): n=t or g
caatgagccaagttcgaatagcttgcgagacttgagcttttcttgatagccctacatgtggagattatggntaccccatacccacacgacatggttatccg

SEQ ID NO: 55228 - DNA, 101 bp, rice(Oryza sativa)
  misc_feature (71): n=a or g
tcaaaattaagtctttaacatgagatattttacgttgcttgagaaagtacaccgaaaattttgatacgtcnagatactaataggtaacaagttttaaacta

SEQ ID NO: 55229 - DNA, 101 bp, rice(Oryza sativa)
  misc_feature (71): n=a or g
ccgttgatatattatacgctgcatataggattgaatgttgctgtgcatctgcggttcttggttcatatttncctgttgtgtgcgggatcatttgtaggggt

SEQ ID NO: 55230 - DNA, 101 bp, rice(Oryza sativa)
  misc_feature (71): n=t or c
cctcaaagccaacaatgaagggtaaagagaaaagactattcatatccttctacttgtttggtggtgtaccnatatttgtctcagaactttcttaagtagaa

SEQ ID NO: 55231 - DNA, 101 bp, rice(Oryza sativa)
  misc_feature (71): n=a or g
gaagggaagacgaaggtaagatgtcaccttccagaaggataaacctaacagctagtaatccaccgtaaganctttgaacacaaaagaagtcacagaggata

SEQ ID NO: 55232 - DNA, 101 bp, rice(Oryza sativa)
  misc_feature (71): n=t or g
gcatggtggtggtgacctaactagaagcagccattgatgcaaatgcgatgcaatgtagtagtgtgatcatntcaccaagaagctgtcctaaaggcttcacc

SEQ ID NO: 55233 - DNA, 101 bp, rice(Oryza sativa)
  misc_feature (71): n=a or c
aatagcatagttgcatctcactgaatgccaaaattcaaatgcccaaacagaacaggcatctccaacataancaccacagtacgacaagactgaattattgt

SEQ ID NO: 55234 - DNA, 101 bp, rice(Oryza sativa)
  misc_feature (71): n=t or g
aactgaaacgtacagtttttcaggcttgaggggcatgtaagaaggaacaaaagcacactgaaacattcggnagatcaagttcagtgaagtgaacaaaaatg

SEQ ID NO: 55235 - DNA, 101 bp, rice(Oryza sativa)
  misc_feature (71): n=t or c
agagattttcatttttcgaggtgaacctagggaagaactggcataaagcattgaattatattaacaagaanatatataaaaaagttggtcctataataaac

SEQ ID NO: 55236 - DNA, 101 bp, rice(Oryza sativa)
  misc_feature (71): n=a or c
agaaggttgtatcggctctttcctccatctccgacaagtcttctgcaccctacttcgtttctaataatagntatataaaaggtggctaataatttctccta

SEQ ID NO: 55237 - DNA, 101 bp, rice(Oryza sativa)
  misc_feature (71): n=a or g
tccatgtgccacaagagaccatgagaggaggagagaagaatcagagaatggagaggggatcttgcaaagtnggaaggaagaaaaagtgtgtgtgagagaag

SEQ ID NO: 55238 - DNA, 101 bp, rice(Oryza sativa)
  misc_feature (71): n=a or g
acctagaactgaaaccggcatttggtctcaccagatcaggagtaatatagtttgcaggatctccaacttcntacagaagctgttctgcacatgtgctgtag

SEQ ID NO: 55239 - DNA, 101 bp, rice(Oryza sativa)
  misc_feature (71): n=a or g
ttttgttgttcctgagcactgtagcattttcaggttggcaccagaaaaatgcaagttggtatgcttgtgtntatagttgccacggtgttcgcgaaaacctt

SEQ ID NO: 55240 - DNA, 101 bp, rice(Oryza sativa)
  misc_feature (71): n=t or c
aggactagtttaagctatttcagaccagtatacctgatctgcctataaatcacaagtccattgccgattanattctagccagtgcaaagtaaggcatttgg

SEQ ID NO: 55241 - DNA, 101 bp, rice(Oryza sativa)
  misc_feature (71): n=a or g
agcaatgggatcataacattctggtcaaaattgctgagttcacaactacttttgagaaacaagttttggcntacaatataatgaccaagaaaagagccatc

SEQ ID NO: 55242 - DNA, 101 bp, rice(Oryza sativa)
  misc_feature (71): n=t or c
ccaacgatctagtggcgacgatcacaggggcctcggcagtgccaagcaagctgaggctccccattgttgtnggctttccctcccccttcccactgccgccg

SEQ ID NO: 55243 - DNA, 101 bp, rice(Oryza sativa)
  misc_feature (71): n=a or g
aagcaacagggacaagtactatgtgacatactatccaatatttgagccagcaatttcagagacatgcattngcaaattaaagatttcaacgcttctgacga

SEQ ID NO: 55244 - DNA, 101 bp, rice(Oryza sativa)
  misc_feature (71): n=a or g
gagtagttgccttgttgtgggttgtgacttgagactagggagtagttgtgtgttgtgtatgcaagagtagncgaggatgtttggtcagtgcactaagtaaa

SEQ ID NO: 55245 - DNA, 101 bp, rice(Oryza sativa)
  misc_feature (71): n=t or c
ggggtgtggtgggagtacaaagttcaaatagaaaattatggggaaaaggctaaaagccttgacaatccacnaaaacaaaatgcttggatttgtgtacttgc

SEQ ID NO: 55246 - DNA, 101 bp, rice(Oryza sativa)
  misc_feature (71): n=a or c
tgaactcaatcattccatttggatcataagctgcagataagcaaatgtgagtaataataatttcacgtgcnttatttacaattactggtaataatcaagaa

SEQ ID NO: 55247 - DNA, 101 bp, rice(Oryza sativa)
  misc_feature (71): n=a or g
ataaatttatgctggtactttttaatttcccccatgatgaattgaactctagtctctaggcagccgatgcnaaattcgatttcttctacaagaaacttata

SEQ ID NO: 55248 - DNA, 101 bp, rice(Oryza sativa)
  misc_feature (71): n=t or g
acacatcggggctgatgttgcagaccaatatgagagccttattgtgcaacgtgtcttgagtgtacaaatgngcaaagcagagcagaaccagcggcataacc

SEQ ID NO: 55249 - DNA, 101 bp, rice(Oryza sativa)
  misc_feature (71): n=a or c
aacaccccattaaactaacctccatcagggggattgattccttccaaatcaaaccaccaaaccatcttctntcttcctctcctcctcccttcgtcggcgtg

SEQ ID NO: 55250 - DNA, 101 bp, rice(Oryza sativa)
  misc_feature (71): n=t or c
tcttgggagctttgcagtcgtgtatatcattctgattattcttgcgcttggaacccttagaagatgtttgnccttgagaaacaacaatacaaaatatcaag

SEQ ID NO: 55251 - DNA, 101 bp, rice(Oryza sativa)
  misc_feature (71): n=t or c
aataccaagacacggctcaataccagccccttcccccctggatttggaggttacatccagtcagctcctgncggtttgtttcttgaactcattgcatggtc

SEQ ID NO: 55252 - DNA, 101 bp, rice(Oryza sativa)
  misc_feature (71): n=a or g
gtaggcactgccggtagtgagattcggatggagcatgcagccaagagaaaggggagaatgagggaagagtnaggtagaaatgagggctattttgtcgaata

SEQ ID NO: 55253 - DNA, 101 bp, rice(Oryza sativa)
  misc_feature (71): n=a or c
acctgcttcttcctcgccgttccaaagagagaaatcagcactagtattcctcaatcagacagtcgtgactnttgacctctctctcacacacaatcacaaat

SEQ ID NO: 55254 - DNA, 101 bp, rice(Oryza sativa)
  misc_feature (71): n=a or g
aaaaaaacaacgaaaaaaaaagactaaagatgatagctcgtgccacgtggtgctaccatcaacaccaaccnggaatggatctttagtcccgattatttcaa

SEQ ID NO: 55255 - DNA, 101 bp, rice(Oryza sativa)
  misc_feature (71): n=t or g
gtgtttcttgctcgccgctgcttggatcagcgtcggtggcatgcatgcgtccaagttgttttcctgacttncttcaattctttcctcaaggcaaattaaag

SEQ ID NO: 55256 - DNA, 101 bp, rice(Oryza sativa)
  misc_feature (71): n=t or c
tggccatcaaatatagcttaattggtagagtagtagttgccttgcaaggatcactcaaatatatgtatccnagtatatgaatatcctagggcattgagtaa

SEQ ID NO: 55257 - DNA, 101 bp, rice(Oryza sativa)
  misc_feature (71): n=a or g
tttgtgagctctgaatctgaatcgatatatgtgatcatcccttttattggatcaatgctattacaaatatnccattttagataaatgtcattactattcac

SEQ ID NO: 55258 - DNA, 101 bp, rice(Oryza sativa)
  misc_feature (71): n=t or c
ccatgttttttcctctccagcttgctacccttctggaaattttgtcaaagacaggttgcaagtccaccttncgcagtcttcccagagctagggggaggccc

SEQ ID NO: 55259 - DNA, 101 bp, rice(Oryza sativa)
  misc_feature (71): n=t or c
cgtgacgggccggccaatgattctaggccggatagcgtaggaatgcatggcctcgttaggctctttgattnggaggaaaataatatgaattgtagagggtt

SEQ ID NO: 55260 - DNA, 101 bp, rice(Oryza sativa)
  misc_feature (71): n=t or c
acgccgacatggatctcttcccggtaaccacgcggttatggaaaaaaaaacacgataatcttcttaaattnaaataaattttaaaaataatttaaaaaatt

SEQ ID NO: 55261 - DNA, 101 bp, rice(Oryza sativa)
  misc_feature (71): n=t or c
ccttttcaatttatgtcgaacacagacatatatagtccacattttccccgaaacataaataaaaaagttanagtacattagttattgttgtatattctatc

SEQ ID NO: 55262 - DNA, 101 bp, rice(Oryza sativa)
  misc_feature (71): n=t or c
actccaaaaagctatgcactatattatctttgtatggcttacgttacctcccttagcttctaaaatgggcntgcttcagtgagaatcccttggaaggcaaa

SEQ ID NO: 55263 - DNA, 101 bp, rice(Oryza sativa)
  misc_feature (71): n=a or c
ttctacttgtgaaagactgaaattcatgtcattttagtcatggagttatatctagtagccagcaaaccacngctatagtcatgatcacaatgatttgtaca

SEQ ID NO: 55264 - DNA, 101 bp, rice(Oryza sativa)
  misc_feature (71): n=t or c
ctcgtgtgcacggcactgtactacttgctcgtaccacacaaggacagctgcactacaacctctaatttganccataatttagttaattaattaatcagtct

SEQ ID NO: 55265 - DNA, 101 bp, rice(Oryza sativa)
  misc_feature (71): n=a or g
agccatatgatggtggccgttatgttgttctattcaacctatatgctgtcaatggtcgatgggaagaagcnaggaccattcggcagatgatggaggatagg

SEQ ID NO: 55266 - DNA, 101 bp, rice(Oryza sativa)
  misc_feature (71): n=a or c
gtgaaggagcactaggagtggatcgaccagaactgagaatcaaactcttttgatcgatctctctctctatntatatatatataagtacataactgttctag

SEQ ID NO: 55267 - DNA, 101 bp, rice(Oryza sativa)
  misc_feature (71): n=a or g
tggtcctactccaaccatgttggcactgttttgcagaagggaagaggaagatggatcagcaccacgtgcancagcagcagtatgttgacccttatcggaca

SEQ ID NO: 55268 - DNA, 101 bp, rice(Oryza sativa)
  misc_feature (71): n=t or g
gcagcaaaagggtgcaaatcttcaacagaaatacattgcagaaaaggtgttcgaccttctgaaggtatganttgtttgctaaatgccgttctggcttctga

SEQ ID NO: 55269 - DNA, 101 bp, rice(Oryza sativa)
  misc_feature (71): n=t or c
aaatcatggtttagtgagacgttgtggaaaaaaaaacaaaagtcatggcttagctaacatcttgcttcctncatcgtaaagaagtatagtaacttttaggt

SEQ ID NO: 55270 - DNA, 101 bp, rice(Oryza sativa)
  misc_feature (71): n=a or c
agactcggtctattggctcagcttaacggtctaggatgcttgtttatttaaaacaaactagtacagataangtgataatattataggtgccaaattttatt

SEQ ID NO: 55271 - DNA, 101 bp, rice(Oryza sativa)
  misc_feature (71): n=a or g
tcaatagctcagcgccgtaagctatgccactaaccccagtgacttggcaaatttttttaccatctcagatnaaatgtcagcgctaatatacatggcgctaa

SEQ ID NO: 55272 - DNA, 101 bp, rice(Oryza sativa)
  misc_feature (71): n=t or c
gcgataccgttgcggcgtggcccacgtcccctaattcatctgctaatcctgggagacggcagtgcgacagngacgccttcggtctcgctctttgaaagagc

SEQ ID NO: 55273 - DNA, 101 bp, rice(Oryza sativa)
  misc_feature (71): n=t or c
catcgttcttttgatgttgcaattgtctttcgtttcgggttatgcgtacatgtgcacggttggtaagaaanaattcggaatgagcacaaagaaaagggaat

SEQ ID NO: 55274 - DNA, 101 bp, rice(Oryza sativa)
  misc_feature (71): n=t or c
gaatgctaggagacgagatcctatctcaagcatccgcattgtatgttgggatcctttataaggtaggcaanaagaaatgggtagggcaatctgcatctgtt

SEQ ID NO: 55275 - DNA, 101 bp, rice(Oryza sativa)
  misc_feature (71): n=a or c
gttgtggactacttgagtctatgtattcctgtaatccattatctaaaaagaaaaaacctaacaagtactcnttaagtagtctgaagatgcttacttgttaa

SEQ ID NO: 55276 - DNA, 101 bp, rice(Oryza sativa)
  misc_feature (71): n=a or g
catgaagcttctccctcttctcatcctcgcaatggtcatggccaacgccttcggcgccgtcacttctcgcncggcgccgggggaggaggcgctgctggcgc

SEQ ID NO: 55277 - DNA, 101 bp, rice(Oryza sativa)
  misc_feature (71): n=t or c
accggcaaagcccgctggactggctcctcacccacatcctccctccccatcccccctccaaccttcttctncaggtctagcaatgtgaagcacccgcgcgg

SEQ ID NO: 55278 - DNA, 101 bp, rice(Oryza sativa)
  misc_feature (71): n=a or g
gggacctaccagatgagatggctcacatgagaagctaattagaacgttgcgctatcctgagactaaggtantgtgggaggagaagagctgatgtccatgat

SEQ ID NO: 55279 - DNA, 101 bp, rice(Oryza sativa)
  misc_feature (71): n=a or g
ggtgtctgtcttgcaaatgcagatttgagaggggacgtatattctggaagtaggtggttgcagcttttgcncaatatatatatatatatatatatatatat

SEQ ID NO: 55280 - DNA, 101 bp, rice(Oryza sativa)
  misc_feature (71): n=t or c
agtaaccaagaacagtactactagacattcgattattaacaatgactgaaaaagtgcccgtgcgttgcaangggaagaacattgaggaaaagttgagagag

SEQ ID NO: 55281 - DNA, 101 bp, rice(Oryza sativa)
  misc_feature (71): n=a or c
gcttgcctgagttggcatggtcaaaataccttcctccggtacaatctgcatggagatggaggagaaatcgncaatcatatgtgaccatgccactgcctaga

SEQ ID NO: 55282 - DNA, 101 bp, rice(Oryza sativa)
  misc_feature (71): n=t or c
ccattattaagaatcttatttctgtacgtcgctttgtctttgataactggtgttccgtcgagttcgacccntttggctttactgtgaaggatctgcgtacc

SEQ ID NO: 55283 - DNA, 101 bp, rice(Oryza sativa)
  misc_feature (71): n=t or g
atgctgaccggtgagctcacatgtgacacaacactgcactaagaactgctacagtgtcagtagctttgcanctagctatgcactatgctctctgccactgc

SEQ ID NO: 55284 - DNA, 101 bp, rice(Oryza sativa)
  misc_feature (71): n=a or g
gaacctagggttcacggttttggaaaccaccaaaatttcataattttcgtgaatttcagacttttgttacntgaaattatttgaaattttaacaaactcct

SEQ ID NO: 55285 - DNA, 101 bp, rice(Oryza sativa)
  misc_feature (71): n=a or c
atagctggatttaatcacatctagcaccccgttgagaaggacaagaatgaacatgacttgttgcatggcantatagcactttgatgatgtgtcgtcttccg

SEQ ID NO: 55286 - DNA, 101 bp, rice(Oryza sativa)
  misc_feature (71): n=t or c
actgtttcgccccaagcgaactccttgatcatcaagcagcgtttcgcaagtgtgatggtttcggcatcttnggtcgaaggccctcgtgacatgtctcgaac

SEQ ID NO: 55287 - DNA, 101 bp, rice(Oryza sativa)
  misc_feature (71): n=t or g
caagtttccttaattcctcttgctttgtttagtggcagttttacttgtggactaagggatgaccgtgagcntgtaatgccagagctgaagttgaggtttta

SEQ ID NO: 55288 - DNA, 101 bp, rice(Oryza sativa)
  misc_feature (71): n=a or g
tgcacacgtacctacattatagccgagctagctactgcatcatccgtccagtcaagagtcaactcacccancttattgcctttcggcctccaagcttttag

SEQ ID NO: 55289 - DNA, 101 bp, rice(Oryza sativa)
  misc_feature (71): n=t or c
gactcaacgtgtgggttcagcatgtctatgactcctccttttttccttatcttttgtctctctcctcactngtctcttcactggcaacattggtaggaggt

SEQ ID NO: 55290 - DNA, 101 bp, rice(Oryza sativa)
  misc_feature (71): n=a or g
ttcattcttgagtaactcctgtcacaaattcgagtgtgaggcaacactgacgttcgagtttgtgacagtancctacataattggtgtacctgtttaaacac

SEQ ID NO: 55291 - DNA, 101 bp, rice(Oryza sativa)
  misc_feature (71): n=t or c
attacgtccctaaactattgagtgagtacgaattaacttctcagacccgaaaatcatatactacatccgtnccaaaataggtgcatccatagatatcagtg

SEQ ID NO: 55292 - DNA, 101 bp, rice(Oryza sativa)
  misc_feature (71): n=a or g
gatctcagctggtagtagatcaactgttttgtttgcagggagagtttgcataagcattttgcaggcaatgntacatctgaggaccaaaaccagccacctca

SEQ ID NO: 55293 - DNA, 101 bp, rice(Oryza sativa)
  misc_feature (71): n=t or c
caaacaatggagcaatgtctgattagtactagactggtgctttcatatgcttgcacaaaattcaggaagcncagtaccatcttcatgaataagcagcattc

SEQ ID NO: 55294 - DNA, 101 bp, rice(Oryza sativa)
  misc_feature (71): n=a or c
ttttaggttgaactatttggtgcatgaaatttaataacatttacaatctttcttacattgaagacgctagnaataggaattattcctaaatcctgataaca

SEQ ID NO: 55295 - DNA, 101 bp, rice(Oryza sativa)
  misc_feature (71): n=t or g
gttgtgttactgtttgttcatattcaacctgatattctgtggccgttgatgtgttcaagttgatcttttgnataaagattgatgcttgcttgttcatgtat

SEQ ID NO: 55296 - DNA, 101 bp, rice(Oryza sativa)
  misc_feature (71): n=t or c
tccctggaactaaacacatgccaagagatacagacgaatagcgcaaccagagctagaaatggaagccatantagcatcttgttccatttttccatacgaag

SEQ ID NO: 55297 - DNA, 101 bp, rice(Oryza sativa)
  misc_feature (71): n=t or c
ttagtgtgggtactgtctactcctactccactatagtttaggtgaccaaatatgctggttaattaggtggngtttggatcagggactctgtatttagacac

SEQ ID NO: 55298 - DNA, 101 bp, rice(Oryza sativa)
  misc_feature (71): n=t or c
tttcgtgcttacgatgggtgtttgcaatttcttgtttcaaaataaagtagaaacgcacgcgctcctaacgngtaaatacttttatgaatttttacacagac

SEQ ID NO: 55299 - DNA, 101 bp, rice(Oryza sativa)
  misc_feature (71): n=a or g
agtgacctgcaaatattttaaagaggccgtatgtttcatatgaaatgtacgaagacctacagtcccagtanccggtttgaccacaagagttcatgctgacc

SEQ ID NO: 55300 - DNA, 101 bp, rice(Oryza sativa)
  misc_feature (71): n=a or c
aaaacatgttaaacctgcagcacacaaacaaatcaataacttggccaatatagcaacttggccagaagtcnaaaatataaccagatgggttaccagtatgt

SEQ ID NO: 55301 - DNA, 101 bp, rice(Oryza sativa)
  misc_feature (71): n=a or c
ggagctggagctgtaccaagcagaccctaactcgtcctcccgacctatgcacgtgtgtatttttgcattanctctgtcatctcattcaatcgcgtacggag

SEQ ID NO: 55302 - DNA, 101 bp, rice(Oryza sativa)
  misc_feature (71): n=t or c
gcatccaatgctcatagttttatatctactcttccgaatggctacaacacgatggtgcgtcgacctttttntgggatgtatgtgtagtcaagtctaattca

SEQ ID NO: 55303 - DNA, 101 bp, rice(Oryza sativa)
  misc_feature (71): n=a or g
ttgaagataagatttcacacgtaggggtaatgctattgaaagtacgtgtcaaatttttttcaagaatttcngtgatatttgctagttggtgtgcacagagt

SEQ ID NO: 55304 - DNA, 101 bp, rice(Oryza sativa)
  misc_feature (71): n=t or g
attaggtatgtggtatccataaccctcataaaggtgatgctcgtttcttccaaagataaaaataaagtcanggtgcacaaaataaaaaaaaccattagtgt

SEQ ID NO: 55305 - DNA, 101 bp, rice(Oryza sativa)
  misc_feature (71): n=a or g
aaggtatcggtgtactcacatgtggcagtagctgctgcatgagaccatttggtttcccgctaatcatctcnaggagaatcactccgaagctgtagacatct

SEQ ID NO: 55306 - DNA, 101 bp, rice(Oryza sativa)
  misc_feature (71): n=t or c
atgtacgatttcaattaggttaattagctactcatctactccctccatcttaaatatttggcgccgttgantttttaaaatatgttttaccgttcatctta

SEQ ID NO: 55307 - DNA, 101 bp, rice(Oryza sativa)
  misc_feature (71): n=a or g
ccctgtcccatcttgaaaggcgtggtgatgcaggtatgtcaccatcaatatcaacggcacctttttaaccnaggtaaataagtcagccttaagattgtgca

SEQ ID NO: 55308 - DNA, 101 bp, rice(Oryza sativa)
  misc_feature (71): n=a or g
gatgagagacaaagaattgaggacgctgggggcttcgtgatgtgggctggtaatttcatgattcctttganattatctattttgctttgtacttgtaatga

SEQ ID NO: 55309 - DNA, 101 bp, rice(Oryza sativa)
  misc_feature (71): n=t or c
tcctgacttaccgtcgtagactcgagaaggtcccacgtggtcattgccacaagtgttaatacaatcaaatnatcaaattttataactttggcctgaccttc

SEQ ID NO: 55310 - DNA, 101 bp, rice(Oryza sativa)
  misc_feature (71): n=a or g
ccagaggaatttgtagtgctaatagggatactaccatgcatatccctgggaacaagtccaaggttggagcntggcgccccagacatggaggttaccagggt

SEQ ID NO: 55311 - DNA, 101 bp, rice(Oryza sativa)
  misc_feature (71): n=t or g
tcttctggagttggaagttgcaatagatatgagattttggagtttcatcttcttgcccccaagagaccatntgcgcaatcagtaactactaatagtgcttc

SEQ ID NO: 55312 - DNA, 101 bp, rice(Oryza sativa)
  misc_feature (71): n=t or c
ggaagagggggatataaggccgaggagataagaaaggaattaaaaaaatagcaagaggctgcgtttggctnggttcatcctaaagtgccaattttttttaa

SEQ ID NO: 55313 - DNA, 101 bp, rice(Oryza sativa)
  misc_feature (71): n=a or g
gataactctgaaaacaccaggcagcaaaaagcgaaaacatcaagaacatggaactctaaagtcaaaaccgngcattgcatttttgaggttcccagctcaca

SEQ ID NO: 55314 - DNA, 101 bp, rice(Oryza sativa)
  misc_feature (71): n=a or g
atttcagccaaatgtaaatacatcaaattctttttattcatgaccaagtggcatgttaggaaatgctgtantgcagatgccaccaatgtaattttaatttt

SEQ ID NO: 55315 - DNA, 101 bp, rice(Oryza sativa)
  misc_feature (71): n=a or g
accacaaaaccagaaatgttaatcccttaacttactcaaaccatgcaaaggaggtcccatggtagtatttncacctgattttgctgacgtggcatcctagt

SEQ ID NO: 55316 - DNA, 101 bp, rice(Oryza sativa)
  misc_feature (71): n=a or c
atagtctggaaatttgggttaaatttctgggcgtgacagataacagaacatctcgaacccggccagcaacntcaagatcgaccagaccttgtcacaagagt

SEQ ID NO: 55317 - DNA, 101 bp, rice(Oryza sativa)
  misc_feature (71): n=a or g
ctatgctaccatattagtaacagtacagaaaacaacatgcttggtgaaaacaatgatcctttctaagaatntggagtcaaaagcaacggcagtacggaaag

SEQ ID NO: 55318 - DNA, 101 bp, rice(Oryza sativa)
  misc_feature (71): n=a or g
tccttacaatagatctactagtgtttctcaatttcctttggaactcatttcctcagatgtctacggacctnctcctatttctgttggtagacataaatatt

SEQ ID NO: 55319 - DNA, 101 bp, rice(Oryza sativa)
  misc_feature (71): n=t or c
atgcatggggcaaaatagacaactcccacaaatgctgcttcaacactttgccgtcacgtcaatatatcttncataaattctttatggaataattttttatc

SEQ ID NO: 55320 - DNA, 101 bp, rice(Oryza sativa)
  misc_feature (71): n=t or c
taatacagcatgacactttctaccttattgcatctcatggattaattctcacagtgttggaaagaaggggntttcattttcattattcagttttatttgcc

SEQ ID NO: 55321 - DNA, 101 bp, rice(Oryza sativa)
  misc_feature (71): n=t or c
caaacatatatgtgatagtactaaagttgccgaaatttcagtagggtgtaattgctttcaattaaacaagnccatcatgcacatgtttttgtgattttgct

SEQ ID NO: 55322 - DNA, 101 bp, rice(Oryza sativa)
  misc_feature (71): n=a or g
aatcgcatgaaaaaggtgattttcgcacgtaatcgccctagaccccgccgcacctgataccggcagtggcngacacgccccttccgaggccgtcgccgcta

SEQ ID NO: 55323 - DNA, 101 bp, rice(Oryza sativa)
  misc_feature (71): n=t or g
gcttgtgcttgtgcttgtgcttcaaaggtgagcagtagcatgggctatttatagggtggcaagaggagaanaagacatcatccagaataaatgttgcagtt

SEQ ID NO: 55324 - DNA, 101 bp, rice(Oryza sativa)
  misc_feature (71): n=a or g
cattgattttcctttttaggaaagtcatatcctttcctttttccttcctccctccccctctcccatgcacnccgcccctcccgcttccgagccggcctccc

SEQ ID NO: 55325 - DNA, 101 bp, rice(Oryza sativa)
  misc_feature (71): n=t or c
cagggccttccttctggcccttcagctggtaatgagacactccaacctatctctctctctttttttttatnagttacttcctccattccaaaagattgcaa

SEQ ID NO: 55326 - DNA, 101 bp, rice(Oryza sativa)
  misc_feature (71): n=a or g
ggtgtgacataatgtcatgtgctctttcttacccttttttttttgttagaaacacagtgtacaaatgcagncgcttacaacgtgtgcacactgccacagaa

SEQ ID NO: 55327 - DNA, 101 bp, rice(Oryza sativa)
  misc_feature (71): n=t or g
ggcgagactctattgaaagggttggttgacaggtggcggaaccacaagaaaattgtcataagtgagacgangttcttcttctacctcgaccgttactacat

SEQ ID NO: 55328 - DNA, 101 bp, rice(Oryza sativa)
  misc_feature (71): n=t or c
agttgggctgtaagtgtgtagagtgtggtagtcatggacaaaaggggaaaggaaaaagtccactttgactntcttaattgttcaccgaatctaattcgtga

SEQ ID NO: 55329 - DNA, 101 bp, rice(Oryza sativa)
  misc_feature (71): n=t or g
aggtacaagaattgaaggggagttttatgagcaagtacggacgtgctcttgcaagagcagtgtaccattanagcaggtacaatagcagcagggtataagtt

SEQ ID NO: 55330 - DNA, 101 bp, rice(Oryza sativa)
  misc_feature (71): n=t or g
cacagagttcctccctaatgacctgtcatgcagtgctagtgtaagctaaatacaaatttaacaagcaaaanaaatgaaaaaatccacagagtgaaaaatgg

SEQ ID NO: 55331 - DNA, 101 bp, rice(Oryza sativa)
  misc_feature (71): n=t or c
taattatcagtcgatctctatgtatcgtccgatcccatccaatatctgatcccgccaggataaaaaaaaanaggtaaaacatcttgaaccatggaccgctt

SEQ ID NO: 55332 - DNA, 101 bp, rice(Oryza sativa)
  misc_feature (71): n=t or c
attctgtcaaaatatatagaacttcatcattatgagataaaaggtgtaaactgcatgcacaagtcttcagntagcatagttagctaactaagttattgatt

SEQ ID NO: 55333 - DNA, 101 bp, rice(Oryza sativa)
  misc_feature (71): n=a or c
tcttatagtagatctagtggttgcaatgcagtgtggaccatcttattctcagggctaagttttagtaaccncttcacgctgggctggaatggcaatccaac

SEQ ID NO: 55334 - DNA, 101 bp, rice(Oryza sativa)
  misc_feature (71): n=a or g
tgccaagctgtggcctgtggcctgtgggtggtggcgctgtacactggccactggcacagtatgtgtaaggnaaaaaacacacaaaaaaactgtaattaagc

SEQ ID NO: 55335 - DNA, 101 bp, rice(Oryza sativa)
  misc_feature (71): n=t or c
ttgtaccaatagaaaccagtaatggttgttcttattatgattttattacctcgatataattggttaagttnaataaagtgttttcatattatattttgaaa

SEQ ID NO: 55336 - DNA, 101 bp, rice(Oryza sativa)
  misc_feature (71): n=a or g
attttgcttaaaaaaacactttagggtttgcatatatccagatttaagccttgaagtgagtttttcttttnggacggaggtagctagtacatgaaaaaaat

SEQ ID NO: 55337 - DNA, 101 bp, rice(Oryza sativa)
  misc_feature (71): n=t or c
tgtaatgccacgtaaatgccatgtagatgtaactgttatgtaggacaaatagacgctatgccagtaaaaanagccatcaatgattcaatactattccctat

SEQ ID NO: 55338 - DNA, 101 bp, rice(Oryza sativa)
  misc_feature (71): n=t or c
aggtttgacacctaaatggcagctgcatatgagatcaatcaccaacccatgtacatgtacacatgtccaanactacaaccccttatccagattgcaaagtc

SEQ ID NO: 55339 - DNA, 101 bp, rice(Oryza sativa)
  misc_feature (71): n=a or g
gatacaagcgttaaatgaagattatttatgaagatacaagacataattgctgccaatagccgccagccgcnccagcgagtgaggcatctcttccctagcaa

SEQ ID NO: 55340 - DNA, 101 bp, rice(Oryza sativa)
  misc_feature (71): n=a or c
ttatatggcttggttaatttggccttcctctgtcatgatattttgctacttaatttgctagttcacttctntatgaatcaattatcaataccggtttggct

SEQ ID NO: 55341 - DNA, 101 bp, rice(Oryza sativa)
  misc_feature (71): n=t or c
gcagatctgggatatgcgcaatcttgtgccaatcacgacctctactctttcgacatcgccgcattaatacngggttacaaccaaggatttgaagcctccgc

SEQ ID NO: 55342 - DNA, 101 bp, rice(Oryza sativa)
  misc_feature (71): n=t or c
tgagggctgggtagtgatgcatgtagtttgtcggttactttcaagagtttgttggatgaaatatagtatgnctagctggattaataatatgataggaggga

SEQ ID NO: 55343 - DNA, 101 bp, rice(Oryza sativa)
  misc_feature (71): n=t or c
aaaattggttggtttagttagacggtggtagaatcgaaacaaaatgaagtggccgtttcaactcttaatcnttatcttttacatattatagaaacaaaaaa

SEQ ID NO: 55344 - DNA, 101 bp, rice(Oryza sativa)
  misc_feature (71): n=a or g
ggagagaaaaggatggatgggatgattgaagggatttttctttgatgagccttgggtggacgcgcggatgngatgagtcatactcatatgtcctgcatttc

SEQ ID NO: 55345 - DNA, 101 bp, rice(Oryza sativa)
  misc_feature (71): n=t or c
cagtagatcgtatgctaataattataccctaagtacatgcgaattaagtgacgacatgcatggctgcatanatgctatgctggttcttccagaatccagtc

SEQ ID NO: 55346 - DNA, 101 bp, rice(Oryza sativa)
  misc_feature (71): n=t or c
gattttgcagcgatgtttggaacgctgttgcatgtgtactactgtggagtaacagttttcacagctacccnacccatctgcatctgtacagaatgggaggt

SEQ ID NO: 55347 - DNA, 101 bp, rice(Oryza sativa)
  misc_feature (71): n=a or g
atcttactataaccatgctaaaagtcgacctgcatttgcatagtattcatggacattagatttgaactctnatgggtaaagtcatacacatacaacttcac

SEQ ID NO: 55348 - DNA, 101 bp, rice(Oryza sativa)
  misc_feature (71): n=t or g
atggcgaaggcggtggcggctcggtccgattggacgcaagagattatcaaattggttcctgagttcatccngttcttgagagtgttcttgagctgttcttg

SEQ ID NO: 55349 - DNA, 101 bp, rice(Oryza sativa)
  misc_feature (71): n=t or c
tgaaatgatacacgagatcgatgtatcgatcggtatcttgttgccagaagctaacgagatgatatgtacgncagcagggtttacattaccatcggtaaccg

SEQ ID NO: 55350 - DNA, 101 bp, rice(Oryza sativa)
  misc_feature (71): n=a or c
agaagtaaaaaaatcgttgattcaaagttggggatagcgagaaatgcattgtgctcttgtgctaagtcatntggagctctgatacgcaattatgcgctgcg

SEQ ID NO: 55351 - DNA, 101 bp, rice(Oryza sativa)
  misc_feature (71): n=t or g
gcctggttgccggcggccagcgcggcgatgtactccatgctcctcggctccatcaccatgccactgccacnagcatcatcttgctgctgctccttgcactg

SEQ ID NO: 55352 - DNA, 101 bp, rice(Oryza sativa)
  misc_feature (71): n=a or g
ttcttacctttataaggtaagaaatgctagaatgacttacacgaataacatccttataaaggtggaaaatnctagaatgacttatattatgaaacggaggg

SEQ ID NO: 55353 - DNA, 101 bp, rice(Oryza sativa)
  misc_feature (71): n=t or c
tatactacatactaatcattaatatatgactcgtatttctctcttacatgttttattggagctcatgctanagtggctataaatctgtagcatgtttttcc

SEQ ID NO: 55354 - DNA, 101 bp, rice(Oryza sativa)
  misc_feature (71): n=t or c
gcactcagtttgcatgtgttaaatccatgactcgaggagcaactaggtgttctagctatactggagatganggggaaagttgcctactatggtgattgtgt

SEQ ID NO: 55355 - DNA, 101 bp, rice(Oryza sativa)
  misc_feature (71): n=a or g
atataagtcccactttgttatgttccacatgtcagtggttcaattacatagtagttagagcacctgcaatngtaaattaaggtgctctctataaaacatgt

SEQ ID NO: 55356 - DNA, 101 bp, rice(Oryza sativa)
  misc_feature (71): n=a or g
tggcttattattcatcaaatgtacacagattctgtcagttgttgcagctgaataaattccccccctacgcntttataaacttttcatcctccatcgatgct

SEQ ID NO: 55357 - DNA, 101 bp, rice(Oryza sativa)
  misc_feature (71): n=a or g
atcattaagaaattcgacggaggcggtaaaagattcgtggcatttcactgaccaatgtttcggaaatctgntttgctacagtgcactaggtgccattttgt

SEQ ID NO: 55358 - DNA, 101 bp, rice(Oryza sativa)
  misc_feature (71): n=a or g
acatggacctggcaagttcatgtaccaaaatgagtgttttactagttcatgtactacattacatccatctnaagtttgtgtaccgctagtgtaatttactc

SEQ ID NO: 55359 - DNA, 101 bp, rice(Oryza sativa)
  misc_feature (71): n=t or c
gtccattgtccatttcctgtgcctccattcttcttaaaattagcccaacatctctcaaactcctcctcgtncatactctcataaattaattttcttagctc

SEQ ID NO: 55360 - DNA, 101 bp, rice(Oryza sativa)
  misc_feature (71): n=t or c
aaatatgacaaatgagttccctgatggctaggatagccaatatttcaggacttatttccaataatgaggtngtgatgtagtggtgcagctagctcatctgt

SEQ ID NO: 55361 - DNA, 101 bp, rice(Oryza sativa)
  misc_feature (71): n=t or c
tatatgcattaattcctcctttctgtgctgctttagatgtcgccccatccgccggaaagattgatcgatgnggtaggattcgtcagggggctgagaatgat

SEQ ID NO: 55362 - DNA, 101 bp, rice(Oryza sativa)
  misc_feature (71): n=t or g
taaacaattgcatcctttgttcctcggctcagctctcaaattcctaccaacaaggagggttgtgtatcccncccgggccgcctgaaaacgtacgtaaatcc

SEQ ID NO: 55363 - DNA, 101 bp, rice(Oryza sativa)
  misc_feature (71): n=t or c
agatggatgtcacaccttgaagtaaggatcccatgtgtggctccctgatattttagttggggttgtccaangaggggggggattagttcatctcctagctc

SEQ ID NO: 55364 - DNA, 101 bp, rice(Oryza sativa)
  misc_feature (71): n=t or c
cacgtggacggtcttgatttcataccaatgacagttggagggtattttggtcattttctatagcagtaacngtcatttggagcctataaaaggaggagagg

SEQ ID NO: 55365 - DNA, 101 bp, rice(Oryza sativa)
  misc_feature (71): n=a or c
aggtgatcttaacatatagctagatgagcataaagagaagcaaccatctacatacttgccctgcaggtagnaaccaatccattaaaactgcttttgaaaat

SEQ ID NO: 55366 - DNA, 101 bp, rice(Oryza sativa)
  misc_feature (71): n=t or c
tagaaatgtgactactgaacatgtcaatgttcattgttgatagaactgggagtacggaagatagtctcttnaagatggctaggtcaaaatataagcaaagg

SEQ ID NO: 55367 - DNA, 101 bp, rice(Oryza sativa)
  misc_feature (71): n=t or c
agtgccgcctcgggctctaggagcggtacaaggtgcagctgctggcatagagtttgttgggttcagatccnctagagttggcatcaactccacctggattt

SEQ ID NO: 55368 - DNA, 101 bp, rice(Oryza sativa)
  misc_feature (71): n=t or g
tacacatggttacctagtaaaaaataaatcaaagcagattcaattgcatcggctgttctgggaagctttanattaattctcaattttttgctaagtccaca

SEQ ID NO: 55369 - DNA, 101 bp, rice(Oryza sativa)
  misc_feature (71): n=t or g
ttggggatttattggttctgagtgggacgctggtgtttctgatagaggagaaccaactatagagtagattnaatggcgactgaattttgagggctagaaat

SEQ ID NO: 55370 - DNA, 101 bp, rice(Oryza sativa)
  misc_feature (71): n=a or g
atttttcgaccatttttgttccaagaaacgcctctgatcgcctgtttcagtggttcggtggccatcctgantacctcacgaatccgttctacgtcgggcga

SEQ ID NO: 55371 - DNA, 101 bp, rice(Oryza sativa)
  misc_feature (71): n=t or c
gcatgagggtattaggtaaagtaaaatgcttgttaagtattagctcactatttggcattgcgcctcctgcntccatgctcacaatagaagagaaaaaagtt

SEQ ID NO: 55372 - DNA, 101 bp, rice(Oryza sativa)
  misc_feature (71): n=a or g
gaacaagagaagctggagaagcttgcacgccaggtatgtgaagcacattatctttgccccacttaaaagtntgcagtcatgcatatctgtttctcataact

SEQ ID NO: 55373 - DNA, 101 bp, rice(Oryza sativa)
  misc_feature (71): n=a or c
acttccaaaagttcctccagcacctaaagttgcacagattttggacacttgtgccttgggccaaatttctntccacatttaaagcattcacctctggctct

SEQ ID NO: 55374 - DNA, 101 bp, rice(Oryza sativa)
  misc_feature (71): n=a or g
gttcgtagggtttcttggatgggttctttttgccgaaaaataggatcttttgccgccattctttcttgtgngttgatagtttccttttttctctttgctat

SEQ ID NO: 55375 - DNA, 101 bp, rice(Oryza sativa)
  misc_feature (71): n=t or c
ggttgctggttgaactgatcattggaggagctctagtgtttgcgctagttttgtggttcttactctcttgntgggagcagaaaaggattcgaaatgtcttc

SEQ ID NO: 55376 - DNA, 101 bp, rice(Oryza sativa)
  misc_feature (71): n=a or c
tatttgttcaaaatttcacacaaaaatttcggtgatgcccgatcaaattggctgaaccaaaaagtttaacnttgtgtacaatacatgcccaccattaaact

SEQ ID NO: 55377 - DNA, 101 bp, rice(Oryza sativa)
  misc_feature (71): n=a or g
attccaccggcactcccaatttcagatgaactattgatgctaccaagacagctacaacttccctctatctnggcatagtccctcattggttggtcatcaac

SEQ ID NO: 55378 - DNA, 101 bp, rice(Oryza sativa)
  misc_feature (71): n=t or c
cgtctaaaagaaaagataaaggcaaaaaaaaaaaggattactggcattacatgacaagaacactcagctcntgagctccatgatcagtaccttttaaagca

SEQ ID NO: 55379 - DNA, 101 bp, rice(Oryza sativa)
  misc_feature (71): n=t or c
taaacgacttcctttatgagtatggagggagtacagttcaaaggttaacactagtcatacccacattaaanacaacctattctaatattgaaccaaaacta

SEQ ID NO: 55380 - DNA, 101 bp, rice(Oryza sativa)
  misc_feature (71): n=t or g
gtaatcctatatgaccttgaagaggctaattattgttgccagtccagttaggcctgaaatatttgatcagnctgtagatggataaaataatgaggcatttt

SEQ ID NO: 55381 - DNA, 101 bp, rice(Oryza sativa)
  misc_feature (71): n=a or g
gtatcattatatctaaaaaagctactttagaattatgaatacccatcctacaaatcctagatctgtcactnccatcagtaaaccgcgcttaccatggaggc

SEQ ID NO: 55382 - DNA, 101 bp, rice(Oryza sativa)
  misc_feature (71): n=a or g
tgttttggccaactgtctggattctataccaacaccattttcaggcaggccaaggctgtgattagttcacnccaaaattgaaagtttggttaaaattgaaa

SEQ ID NO: 55383 - DNA, 101 bp, rice(Oryza sativa)
  misc_feature (71): n=a or c
ttaactcctgactgattaagctaaacctttagtttgtaccgtgatggccacttgattgaagcggctagctntctctctagctaggctcagtgaagattttg

SEQ ID NO: 55384 - DNA, 101 bp, rice(Oryza sativa)
  misc_feature (71): n=t or c
atgtcgtgagcttcttgaagatgtctcattgaaagtcccatgttggcatggcatcattgatggttgtgttnctatcgaattagcttcgatggataggcgtt

SEQ ID NO: 55385 - DNA, 101 bp, rice(Oryza sativa)
  misc_feature (71): n=t or g
aagcatatatagtcttgcattgtgctccaactccgtcgacgagagacgattatattgatcgatcgttcaantaaccaacaagcagcatttactttgagtct

SEQ ID NO: 55386 - DNA, 101 bp, rice(Oryza sativa)
  misc_feature (71): n=a or c
gaaagagacagtgacgaaaggaaaaccgaaaaaccgaaagtccttaccgcgtgcgtggaaaaaaaccgcancgaaaaaaatagtggtggcgacaaaaataa

SEQ ID NO: 55387 - DNA, 101 bp, rice(Oryza sativa)
  misc_feature (71): n=t or c
taaaatttatccgaataaaacttatccacctactccttcatcttatccgattacaaacatccccgtttctnaaccattttattatctgatgctttaatttc

SEQ ID NO: 55388 - DNA, 101 bp, rice(Oryza sativa)
  misc_feature (71): n=t or c
agaagtgtacaattagtactaccacatcttagaggaatgaactgtactttctgtcatttttttcttgctangagaagtgaaatggtctacggtaataactt

SEQ ID NO: 55389 - DNA, 101 bp, rice(Oryza sativa)
  misc_feature (71): n=t or c
aaatacttctcgagcacatcaattaccttaagcacatcggcatccgtatatcaacaatcttcccaacttangtgtaaactattatttactattattgtaca

SEQ ID NO: 55390 - DNA, 101 bp, rice(Oryza sativa)
  misc_feature (71): n=a or g
ccaaatataataacctaaaatcgaatggaacatttcctagtactacgtctgtctagattcgtactacttgnaaatgtcaatgtcacatccggtactagatt

SEQ ID NO: 55391 - DNA, 101 bp, rice(Oryza sativa)
  misc_feature (71): n=a or g
atattcgatccaccccaatagtcatacggagattcttatagggatagggatatagggtgtgcatgtgtgcncacgtgtatatgagctttatttttatacta

SEQ ID NO: 55392 - DNA, 101 bp, rice(Oryza sativa)
  misc_feature (71): n=t or c
gagccaggtaccatgcaggcaaccaaacatgccctatggtttggtcccttacgggcccaaccttaatatgnaataccacccccgccttgccagtgctagca

SEQ ID NO: 55393 - DNA, 101 bp, rice(Oryza sativa)
  misc_feature (71): n=t or c
gagcaggggaaatctccagaaggagtgctctgaatatcatagttttctttgagaattttacaaaggagtgnggggcgtgtcgacgttcttccaacggagtt

SEQ ID NO: 55394 - DNA, 101 bp, rice(Oryza sativa)
  misc_feature (71): n=t or c
gatgggctgggctctgcaatctaaatctggaacgttctcacggcctatgtatgtgtttggttcacgctcanattttaccacgtcacacctttgatggccat

SEQ ID NO: 55395 - DNA, 101 bp, rice(Oryza sativa)
  misc_feature (71): n=t or g
tgtcttaactgacacttgatgattggtttgctgtgttgaacatagagcggatttctctgaatgccctgtcnctcctgtaaattgtgatttaagcagtaact

SEQ ID NO: 55396 - DNA, 101 bp, rice(Oryza sativa)
  misc_feature (71): n=a or g
cctgatcacaaaatcattcggaggcacctttaatttggaaactgaagagtcgcgcctcctcgactcctcanctcgcgcacgcggcaccgtacgatcaagct

SEQ ID NO: 55397 - DNA, 101 bp, rice(Oryza sativa)
  misc_feature (71): n=a or g
aatatgtaacagtgctgattactgttggtccgggagccattgttcaattactcatggtctttactatattnatggcctagctccatcgccaacttcaacct

SEQ ID NO: 55398 - DNA, 101 bp, rice(Oryza sativa)
  misc_feature (71): n=a or c
taaagctggtacaaatttgctgcacacttgttttagctgttgtggctatacaacaggcagctctacaaaanaccccctttgtgttcaacccaaattaaaca

SEQ ID NO: 55399 - DNA, 101 bp, rice(Oryza sativa)
  misc_feature (71): n=t or c
cgtgccctgtaacatttgtaggcacctcttgaccactagtcacaaaaacgtcagatttgcaattttgccangtataagtggatggcatttgttcttctgcg

SEQ ID NO: 55400 - DNA, 101 bp, rice(Oryza sativa)
  misc_feature (71): n=a or g
gtatcatgtatttgttggagaagacaacaatttattaactgatcagtttgtcagtgatggtgaagatggcngaacctcacctaagagatgtcggtgacggt

SEQ ID NO: 55401 - DNA, 101 bp, rice(Oryza sativa)
  misc_feature (71): n=t or g
gattttctccggtaatattatatccttataagcttctcaaacctaacctatgatgcatgcccgcacattcncgtggtcttatataaaacaaaacagaaaat

SEQ ID NO: 55402 - DNA, 101 bp, rice(Oryza sativa)
  misc_feature (71): n=t or c
ggccgcttcctctgcgccgttgggtaccccaatatgcaggattacgtcgatcacttcgtcaccaaataccnagagatcacgataaaactcaaagagtacgt

SEQ ID NO: 55403 - DNA, 101 bp, rice(Oryza sativa)
  misc_feature (71): n=t or c
acttcccacgcctgaggcctccttcgtccaaaggagttgaagcacccttgccctggaaccgcttctagtcngggctggaccgttctggcgctaggccgcta

SEQ ID NO: 55404 - DNA, 101 bp, rice(Oryza sativa)
  misc_feature (71): n=t or c
ccgaatactttgattcggtaggggtactaaggccattttcaacgcgaggacagtggtcccgttcttttgtncaaccagagttggatgaagattaagatttt

SEQ ID NO: 55405 - DNA, 101 bp, rice(Oryza sativa)
  misc_feature (71): n=a or g
tgcgaagacatcccttgctcacacatatttgttgtactcaagttccttggttttgacaccatccctcgttnttgtgtcgtggataggtggacaatgggagc

SEQ ID NO: 55406 - DNA, 101 bp, rice(Oryza sativa)
  misc_feature (71): n=t or c
aagaattagagtccagcttagctaacttttttcccactgagatttcatacatctatgtcttatttcttctntttttttctcttttcttttatttcttctct

SEQ ID NO: 55407 - DNA, 101 bp, rice(Oryza sativa)
  misc_feature (71): n=a or c
cgaaaaactacagcaaataattggaagcacttctaacaatgataatctgccaaatacagatgaaaaagaangaatatctctttcgcagccttgcctaaaaa

SEQ ID NO: 55408 - DNA, 101 bp, rice(Oryza sativa)
  misc_feature (71): n=t or c
gttgcagaattcgctacctcctattagctgctagttactaaatggtaaatgtggtacctcctgatacatcnaatagggtgaaatctatctatctataccta

SEQ ID NO: 55409 - DNA, 101 bp, rice(Oryza sativa)
  misc_feature (71): n=a or g
catgcagataactacacaagatttcataacaatgaagttgagtagacgatgagcaatgcattcaagactcngaaaatttaatgtgtttttagcattactta

SEQ ID NO: 55410 - DNA, 101 bp, rice(Oryza sativa)
  misc_feature (71): n=t or g
tagctaattaattctgcaactaggtagcagcagatcgatggacttgtggaggaggataaatatacgttcancatgcctctggctacacttgtgcacataaa

SEQ ID NO: 55411 - DNA, 101 bp, rice(Oryza sativa)
  misc_feature (71): n=a or g
cagttactttgatgtgcccttctgggatactatgagatttcccatcattttgggaattgaggacttgttcnttccaaaatgaactttacctaattttagtc

SEQ ID NO: 55412 - DNA, 101 bp, rice(Oryza sativa)
  misc_feature (71): n=a or g
gtgaaaacttcaccttaaaaataacatgccctgctttgctgctcatcaccatcgcattcatcacaataaanaaatatttatcacaatcacaaaaacattca

SEQ ID NO: 55413 - DNA, 101 bp, rice(Oryza sativa)
  misc_feature (71): n=t or g
tgtacaattcaggatttggaatccatttagagtaggtttaatagttagctataagggaactataaatatanagaaattttacagttcttgagaaaattcat

SEQ ID NO: 55414 - DNA, 101 bp, rice(Oryza sativa)
  misc_feature (71): n=t or c
catgggtttctgtgacgcaacacgtgtcttgtctgtgtgccagttgtcaaaatcaaccttaagggtgtgtnctgtcgtatcggaagagaaagtatatacta

SEQ ID NO: 55415 - DNA, 101 bp, rice(Oryza sativa)
  misc_feature (71): n=t or c
gtgttgattcatatttgatgtacaaaccaatatgctactttctctatcttgaaatacttgtcattttaggnagtttagcatgtattaaagtttaagaaaaa

SEQ ID NO: 55416 - DNA, 101 bp, rice(Oryza sativa)
  misc_feature (71): n=t or g
aggtagcttccatgcatgtaaacgaataatttccactaattttccactagccaactaaatgcatgtaacantccaatcaactcttaattaatttacataca

SEQ ID NO: 55417 - DNA, 101 bp, rice(Oryza sativa)
  misc_feature (71): n=a or g
agtatatgcttaagtgctagcaacatgaatatataattgtggcgggcagctaagcagcaaggccggtcctnggttttcgaggccctagggcgaaaacttat

SEQ ID NO: 55418 - DNA, 101 bp, rice(Oryza sativa)
  misc_feature (71): n=a or g
tatatatcgttttattttatttaagtttgtttctataagtttacaacgtcaaccatggtagcatggcaagncaatgcagtgccgcggtgcaacggaaatat

SEQ ID NO: 55419 - DNA, 101 bp, rice(Oryza sativa)
  misc_feature (71): n=t or g
gtgggaaggctagtgtgatcacatactcatctatgtcagcacgcatatccactctattctccggtttgacngggaacttttgtctccacatgtagtagcca

SEQ ID NO: 55420 - DNA, 101 bp, rice(Oryza sativa)
  misc_feature (71): n=t or g
ttgcatggttttctaggaaacaatctactgctgaatctaaatatgttgctactgctagatgttgttcacanattctttggcttttatatactttaaaatat

SEQ ID NO: 55421 - DNA, 101 bp, rice(Oryza sativa)
  misc_feature (71): n=t or c
tgttggtgccattagcgacggcgtggcggtggtgaccttgatggcggtggcgttcttgttcttgtagacgnggatgggggtgtcgtcgacgaggaagacga

SEQ ID NO: 55422 - DNA, 101 bp, rice(Oryza sativa)
  misc_feature (71): n=a or g
aaagagtaccggccttcattcgtcctaaaacaaatgcagctatatactaattcaaattttgagacggatanagtagcagtctttataacagtggaagcgtt

SEQ ID NO: 55423 - DNA, 101 bp, rice(Oryza sativa)
  misc_feature (71): n=a or g
agaccggcattacgcgagcggtataaccagccagtggtctaaccggcgttaggcaagtggtcagatcagcngcggcagtgcgcaacaggcatgtaggagca

SEQ ID NO: 55424 - DNA, 101 bp, rice(Oryza sativa)
  misc_feature (71): n=t or c
tgatgtttggccacatttcattatcaatgttttattttagccaccttaaactaattatttcgttttaggcnagataatcttgtcaagtttagagccacgga

SEQ ID NO: 55425 - DNA, 101 bp, rice(Oryza sativa)
  misc_feature (71): n=a or g
caaagttgttataccaagggaccatcaaccccaacttctaggtgattgattatcgatccctacttgaagancttggttaagtagtactagctcataaagtg

SEQ ID NO: 55426 - DNA, 101 bp, rice(Oryza sativa)
  misc_feature (71): n=a or g
gggagtatataaaatgtcacgtctaatcataggtgaatttatattgggacgggggagtgtgagctagtagnccgccacgcaccaactcagaaacgatgatt

SEQ ID NO: 55427 - DNA, 101 bp, rice(Oryza sativa)
  misc_feature (71): n=a or g
tgtagaaatgtctccccggagctgaggattttataatgaaaatatttactattgtacagagtaaaccgatngaaataatcaaatggaatattttatggcaa

SEQ ID NO: 55428 - DNA, 101 bp, rice(Oryza sativa)
  misc_feature (71): n=t or c
gtgtaagagtatttcttcactccaaatgcggataaaacgaagggttccatgtgaaaaaaacacccactgcngcttcccaaagagactgatctatactccct

SEQ ID NO: 55429 - DNA, 101 bp, rice(Oryza sativa)
  misc_feature (71): n=a or g
tacacaatgcagaacaatccattcttgtggtcacttctgtgagtaaaacaattacacaatgcgccaatagntcttcagtcatgtactcctgtggccggtgt

SEQ ID NO: 55430 - DNA, 101 bp, rice(Oryza sativa)
  misc_feature (71): n=a or g
tttaaaggtatgtgtgctggatatgggccaggtggggtaaaagctgtaagccaattttttagtccaactcncaaaaagttgcaagcctacaacgcgtaggc

SEQ ID NO: 55431 - DNA, 101 bp, rice(Oryza sativa)
  misc_feature (71): n=a or c
gcaaggttgaatgaaaagcactttcttggaataaccgtaaaagccatagcaagagaagaaaacggagaagncaatgagctagcaaaagcagctgctgcagg

SEQ ID NO: 55432 - DNA, 101 bp, rice(Oryza sativa)
  misc_feature (71): n=t or c
cagatttatagcaaattccacacatttctagcgaaccattcaaccaatgaaagaacccaaccttcttaggnggtttgaaggaaaaacaaaaggatttggat

SEQ ID NO: 55433 - DNA, 101 bp, rice(Oryza sativa)
  misc_feature (71): n=t or g
gtgatatcgataagggggcattggtttgtggagcacaattgctctgatgtattttggtgttggtctgagtnactttttggtacatcaaagtgattttggtc

SEQ ID NO: 55434 - DNA, 101 bp, rice(Oryza sativa)
  misc_feature (71): n=t or c
gggagtacatgatatggtaaatgttttcactgggatgatgaccgacatagtgacgacaacttgtatggcangagagttcagtagactatagatagatgaaa

SEQ ID NO: 55435 - DNA, 101 bp, rice(Oryza sativa)
  misc_feature (71): n=t or g
gggaacatgaacatgagaagggaaggagcagtgggcataagattgactgcaagattctgcagctttggctntgtttagaccaagtttgtaaaattttggcg

SEQ ID NO: 55436 - DNA, 101 bp, rice(Oryza sativa)
  misc_feature (71): n=t or c
acttcggtttcggctctgtcatgtatatcgtctccttgatgcggcaagtctggggttggtggttcggcgantgccgcaaaagaactgttcagattagccac

SEQ ID NO: 55437 - DNA, 101 bp, rice(Oryza sativa)
  misc_feature (71): n=a or g
aatcataacacaccggctggggcggtccaccctaacgcaatcatcagttgtttccatccttttgttattcntgtgcccaaattgagtaccccatgatatct

SEQ ID NO: 55438 - DNA, 101 bp, rice(Oryza sativa)
  misc_feature (71): n=t or c
atggaggatataatgcaactgtgggtacgtggctagctgatctgccatagctatccaaagagttttttttncttttttttttaggggggggggggggtgtt

SEQ ID NO: 55439 - DNA, 101 bp, rice(Oryza sativa)
  misc_feature (71): n=t or c
cacgtaatggaaaaataattaagagagaaagccatacaccattgccaccgatctatttaatgctaaactanatatactctgtaaaaaaacgatttttagga

SEQ ID NO: 55440 - DNA, 101 bp, rice(Oryza sativa)
  misc_feature (71): n=a or g
aactccctttcagagtaataaaatttcggtttgatctagaggaaatttcatctcaatcaaacgaaggtgtnaccacaagcttgcttgcatgcttatcatgg

SEQ ID NO: 55441 - DNA, 101 bp, rice(Oryza sativa)
  misc_feature (71): n=a or g
cacggatgacgaattaaccgcggaaacatctttcttgaaacaaaagaaaaggcacccacgttgcactcctncccgtggcctccgcctctcactacctgcga

SEQ ID NO: 55442 - DNA, 101 bp, rice(Oryza sativa)
  misc_feature (71): n=t or c
tccaactcaactagagtaagcactacagacaacgtttttaataattgtctctaccacttactcaaaaatantattattttatctatctttgtgggcctaat

SEQ ID NO: 55443 - DNA, 101 bp, rice(Oryza sativa)
  misc_feature (71): n=a or g
ctgcataggtgctgtagcgatcaaatgaagccatcagattacattggatggctctgattctgctcaatctncccaccacttacttgacagttacatggcta

SEQ ID NO: 55444 - DNA, 101 bp, rice(Oryza sativa)
  misc_feature (71): n=a or g
aggatagagaaaactttccttttgatttcattagattgatgtgttcttccatatgtttttgttttcatcancttagttaacttatatgttgcttaattgta

SEQ ID NO: 55445 - DNA, 101 bp, rice(Oryza sativa)
  misc_feature (71): n=a or c
attgctgccactgctgctggatgaccttgtcgtcttctgctctactttacttcctcgttccgatatataanaacctatgatcgggtttgatatctatagat

SEQ ID NO: 55446 - DNA, 101 bp, rice(Oryza sativa)
  misc_feature (71): n=a or g
tcgccaggcctgaggcctgtccagcgcaataacgtagtccagggatcgatgacggaagacgaagaggagcnaaggagaagcgaagcgatctgactcttgtc

SEQ ID NO: 55447 - DNA, 101 bp, rice(Oryza sativa)
  misc_feature (71): n=a or c
agggatctcgattgcacggttttaaaagttggaggacgtgctgtacccggttttcctgtctagggacgaanttaactgagcgacaaattaagggacctaga

SEQ ID NO: 55448 - DNA, 101 bp, rice(Oryza sativa)
  misc_feature (71): n=t or g
tattggaccaaaattcgatttgtccgaacaaaatttggtctttcaacgtacttgagattgaactagcgccnatttttttcggtctcagtttttttgtttgg

SEQ ID NO: 55449 - DNA, 101 bp, rice(Oryza sativa)
  misc_feature (71): n=t or c
gtttgcttatcaaccttgcaattttaggttcactaattttatagcagggtagaacagactaatccacgatncgttgctccactcaacgttcacaagggtca

SEQ ID NO: 55450 - DNA, 101 bp, rice(Oryza sativa)
  misc_feature (71): n=t or g
ccaaagggccaaagaggatgaccaagcaggagaggagggttaaaatagagaaatttgttgaggagtaggtngctttgtcctgttggcatttgtgaatcttg

SEQ ID NO: 55451 - DNA, 101 bp, rice(Oryza sativa)
  misc_feature (71): n=t or c
cgtacaaaaagtttttttaataatacaaaatatttcatccatcacatgaaattcctaaaagatctatgttnggatattgcttgtggtacaatatgtagtgg

SEQ ID NO: 55452 - DNA, 101 bp, rice(Oryza sativa)
  misc_feature (71): n=a or c
gtccggaagaaaggcaagcatttcgaatagaaggcggaccaccataagaagcctatatttcgaaacggtanaaccgtgttcgaaatggtgaaagatctcaa

SEQ ID NO: 55453 - DNA, 101 bp, rice(Oryza sativa)
  misc_feature (71): n=t or c
aaagggattagaacaagtgctacaatatgtatagagtcaatcctacctccttttctctcctatagaacccntttaagtctaacattgcagatgctatatga

SEQ ID NO: 55454 - DNA, 101 bp, rice(Oryza sativa)
  misc_feature (71): n=a or g
caggtagagcacaggtatgccacagagcttaagcatgccacgagggtctacttgttcgtcgagtggaggcngcaatgtgggtcgaccaactccagtgccag

SEQ ID NO: 55455 - DNA, 101 bp, rice(Oryza sativa)
  misc_feature (71): n=a or g
acgggcaagcagtaacccaagcgtcggcattctcagcacgcgcgcgcaaaaaaattaccacggcatacacncgcgaatagcggtaacgagcgccaggcaaa

SEQ ID NO: 55456 - DNA, 101 bp, rice(Oryza sativa)
  misc_feature (71): n=t or c
tgcacaaaacgaagtacttagatcccctgataacctcctggtatgttaggtacaatggaagcaaaattcgncggacaatttgatcaccttgtgatctagac

SEQ ID NO: 55457 - DNA, 101 bp, rice(Oryza sativa)
  misc_feature (71): n=a or g
ccccttcccttcccttcctcactttgcacaactcgatcgctcgcgtggtgggatccgcgctgctgctgctnctactactactactactcttggccgtgacc

SEQ ID NO: 55458 - DNA, 101 bp, rice(Oryza sativa)
  misc_feature (71): n=a or g
ttgagataaatgtaaagtaaagtcggtactcagattataagagtgaagtaaattgccgaaactgaataaanaagaatatttcattaattgtacaagtctta

SEQ ID NO: 55459 - DNA, 101 bp, rice(Oryza sativa)
  misc_feature (71): n=t or c
gagggatgaaattccacatcccaattgctctgcgttcatagtagttctcaagcggtggcagtgggttaganatggcttgcaaggtgttcctgcgtttgcgt

SEQ ID NO: 55460 - DNA, 101 bp, rice(Oryza sativa)
  misc_feature (71): n=a or c
cgggagctgaccctcaatgttgtaatttgtgactctaatcctaatggaaatgagagcgagaaattcctcanttagctctttgtatcatgtaggataaggat

SEQ ID NO: 55461 - DNA, 101 bp, rice(Oryza sativa)
  misc_feature (71): n=t or c
tacgtattctgtacgagtacatatgcgcaggcatgattcatgatgtaatgtgattcactactagaaaaatnatttttttaggcggccaaaagtagtttttt

SEQ ID NO: 55462 - DNA, 101 bp, rice(Oryza sativa)
  misc_feature (71): n=t or c
ttcatacaaaaataaggagaaaatttttacaccgcgcgctaaccagccagccaagcaagtttttcttttanaggagttacacataagttataagttacaat

SEQ ID NO: 55463 - DNA, 101 bp, rice(Oryza sativa)
  misc_feature (71): n=t or c
atgtttgtgctagctgctgacctccttcaatcaatgatcaagaaggcacataaaggaattttcactatgcngataacaaaaccagatggtaaatttccagt

SEQ ID NO: 55464 - DNA, 101 bp, rice(Oryza sativa)
  misc_feature (71): n=t or c
tattaattgtatacatttgctaaattttgttggattatttgaaattattatgcagtgatctctccaacagnaaattgaatgggtcgatatctaattttttc

SEQ ID NO: 55465 - DNA, 101 bp, rice(Oryza sativa)
  misc_feature (71): n=t or c
ccaactcctctcctctctccccctcttgcatgcaaaactaccaccccttcacatatttttttactctatcnactctcttttccctccgaccacttcaaatt

SEQ ID NO: 55466 - DNA, 101 bp, rice(Oryza sativa)
  misc_feature (71): n=t or c
cttcaacttctggcggaacttcttttttcgggccgatccacttgatgttcgccatgatgtgtccatatttngtacttttctataaatccacaagttactaa

SEQ ID NO: 55467 - DNA, 101 bp, rice(Oryza sativa)
  misc_feature (71): n=a or g
gtaagtttgagtggcatatatcaaggttgtttgtctaacagtaaggtggtatatgtcaaaatttagctgcngaatgtacaatgaacaatatatccactggt

SEQ ID NO: 55468 - DNA, 101 bp, rice(Oryza sativa)
  misc_feature (71): n=t or c
ctctccttcttcaatctccctcccactcctcttctcactcgcgccaaagccaaggatggcaatgctccttngcctccgccattggcgcccgagcgatctcc

SEQ ID NO: 55469 - DNA, 101 bp, rice(Oryza sativa)
  misc_feature (71): n=t or c
gctcaatgggttgaatgtgttcgtatcatatatatttttaggctcctaactcatctttctgtagttaatgnttgattcaattgatggttgcttttaggaaa

SEQ ID NO: 55470 - DNA, 101 bp, rice(Oryza sativa)
  misc_feature (71): n=a or c
gagagctcggcttacaaatagttgaacaccgaacccgggatacaataatcttctaccctgttttctaacangagcagaagagagggcactaacatgtacca

SEQ ID NO: 55471 - DNA, 101 bp, rice(Oryza sativa)
  misc_feature (71): n=t or c
aataatactcttcctgaggatcacgcagaagctgagaagctcacgcgtgtctctaagcgatacgtgctcanagaagggaccctctaccggcgtgccgccaa

SEQ ID NO: 55472 - DNA, 101 bp, rice(Oryza sativa)
  misc_feature (71): n=t or c
ttgttaggggcacacagtgtcctttacaagcatgagcacctattgggctaaatgtcttggcccatttattngtcgagatcccccgaaagcacaacggccgc

SEQ ID NO: 55473 - DNA, 101 bp, rice(Oryza sativa)
  misc_feature (71): n=a or g
ttcggtcttttttattttttttggtcccagtactgaattagtggcttgacggccagaataatatattgtcncggccaatttatctaatcgcactttttccc

SEQ ID NO: 55474 - DNA, 101 bp, rice(Oryza sativa)
  misc_feature (71): n=a or g
tgattaatatgtgtgtttatagctcagtgcaatcatcaatgactgaatccaccttctcttttctttttgtntagtctgaaaattacagatcttgagatcca

SEQ ID NO: 55475 - DNA, 101 bp, rice(Oryza sativa)
  misc_feature (71): n=t or g
gggtggagcaaccacctgactcaaggtgttagtgaaaatcaattttcacctatgggaggcacatcagcacntgaaaactgattttactgtgccttcatcgt

SEQ ID NO: 55476 - DNA, 101 bp, rice(Oryza sativa)
  misc_feature (71): n=t or c
accaggccaccagccaccgcggctacatcatcggacagaggagattcaagattagaaaactagggttcacntcaatcggacaaaaactagtacctacgcga

SEQ ID NO: 55477 - DNA, 101 bp, rice(Oryza sativa)
  misc_feature (71): n=a or g
gtggagaagaccgacgcgggcaaccctgtgttcgtcggagaggaggaagatgcagtctagaccaggttctntgtttttttttgtgtatttcagctagtgta

SEQ ID NO: 55478 - DNA, 101 bp, rice(Oryza sativa)
  misc_feature (71): n=a or g
agagaatggcatatgtaagaacgtattacactactcaaaaaatagcaattacactccccaatccgccgccncctccccaccctcatccctcctgctgcctt

SEQ ID NO: 55479 - DNA, 101 bp, rice(Oryza sativa)
  misc_feature (71): n=t or c
cttttgtctttcaacattttgtcttctatttttttttcatttccgagttgtcattttctttaagtcccttncccccaaaaaaattaagttttccttatgga

SEQ ID NO: 55480 - DNA, 101 bp, rice(Oryza sativa)
  misc_feature (71): n=t or c
ttcaatacattaacttgctatcacttgtttccacatttttcacttgttaattgatgcaaaacgtttgtacncaatgttttaaagttatcagattaatttgt

SEQ ID NO: 55481 - DNA, 101 bp, rice(Oryza sativa)
  misc_feature (71): n=t or c
ttctccaacacgatacatagtccaatgcgtcaaaagacggtgatgtagcacccaggctgattctggatgcncacttgtttcgatgattcctagacttagaa

SEQ ID NO: 55482 - DNA, 101 bp, rice(Oryza sativa)
  misc_feature (71): n=a or g
aaattgtacgatttatggtgttcgtaaatgatgaacatgacgaagtaaggaaacacgtgacgagctagaangccaatggcatatgattaattgagttttaa

SEQ ID NO: 55483 - DNA, 101 bp, rice(Oryza sativa)
  misc_feature (71): n=t or c
ttttttagtggttgcaactgctacatcatcttaagttggtgacaatgacatggggcttagaatggtagccngtgttgtctaatttttgtgttcttttagca

SEQ ID NO: 55484 - DNA, 101 bp, rice(Oryza sativa)
  misc_feature (71): n=a or g
aattatattagaaattaaccactatgaacaatcagttttcttaatttctttcttctttgatactccctccntatttcaatgtatgacgccgttgatttttt

SEQ ID NO: 55485 - DNA, 101 bp, rice(Oryza sativa)
  misc_feature (71): n=t or c
tatagaagtgatcccatttaatatatgcaatcacaacacaaggacatatatgtggacttttgcgtcttttngtggattttgatctacagacaatttgaaag

SEQ ID NO: 55486 - DNA, 101 bp, rice(Oryza sativa)
  misc_feature (71): n=t or c
acgccggggcaaccttcgccaagctagtgtacaaggtcttttacaagcaactggggcaaaatgtggaggcntatgtcgacgatatcgtcgtaaaaagccac

SEQ ID NO: 55487 - DNA, 101 bp, rice(Oryza sativa)
  misc_feature (71): n=t or c
aaatcatttttactggtagaagaatactaccagtagagtaccatagcggcactcatgtgatttatagttgnagatcaagcagagttgatattcaatttaag

SEQ ID NO: 55488 - DNA, 101 bp, rice(Oryza sativa)
  misc_feature (71): n=a or g
tcttcatctctctcccctctcctctctcatgtgcgacacgacagagaaggagcggaatccgctagccatcntcgtcgccgccgccgacgtttccccgtgcc

SEQ ID NO: 55489 - DNA, 101 bp, rice(Oryza sativa)
  misc_feature (71): n=a or g
taatactccttccgttgtaaaataagctaacctcgtactataatatggtacatcactgtaggcctattagntacagctccaactcttaaatttagctccag

SEQ ID NO: 55490 - DNA, 101 bp, rice(Oryza sativa)
  misc_feature (71): n=a or c
ggttcaactgccgtaaatgttcttttggtgatggctaacaaacaagtgaacatcacttagtatacataggnctgctttaggtcccaagacaaaaacttttc

SEQ ID NO: 55491 - DNA, 101 bp, rice(Oryza sativa)
  misc_feature (71): n=a or g
tcccctttcaagaagaattcattttgtatattttcctgcatgtctaatcgtttagtttgatccacataatntgaatcgctctagtttatccggtacccgtt

SEQ ID NO: 55492 - DNA, 101 bp, rice(Oryza sativa)
  misc_feature (71): n=t or c
agtttcaaaaaaaattggccaaaaaagtacaaaaaaattcggttctttcagccaccccaggcaaaaatcgnaattggagattgctaaccctggtggcatgc

SEQ ID NO: 55493 - DNA, 101 bp, rice(Oryza sativa)
  misc_feature (71): n=a or g
ttacattcctatacgtgtatatacatcgatccacctaattttgctgacttcctggaaatcttgttacgacncgtagctcctagaaattacaccattattta

SEQ ID NO: 55494 - DNA, 101 bp, rice(Oryza sativa)
  misc_feature (71): n=a or g
ttgaaggtagttttggctggcacgtcaacagaagcaaaaataaaaaataaaaaaatcatgtgggagtgggntctacatgtaagtgaaacatcattttcttc

SEQ ID NO: 55495 - DNA, 101 bp, rice(Oryza sativa)
  misc_feature (71): n=a or g
tcccaacgaggcaatggcttggatgaagctctacagtaaatttgagcagtacatatctacagtattcactnccactcagccagactagcggagtggtgccg

SEQ ID NO: 55496 - DNA, 101 bp, rice(Oryza sativa)
  misc_feature (71): n=a or g
tttagaggaaaatagtccataatcgtggttatttgatagtggacaccgcatggcttaaagtaatgtatccntgccgacgaggcactagggggcctgatatt

SEQ ID NO: 55497 - DNA, 101 bp, rice(Oryza sativa)
  misc_feature (71): n=t or c
agcagcgatctgtggaactgatgagaaagaaaaaaaagaaggcgagatttgatcgattgatcggtcctagntccggacgatttggtcatcaactcgattgg

SEQ ID NO: 55498 - DNA, 101 bp, rice(Oryza sativa)
  misc_feature (71): n=a or g
agattggctggtttgatggtgtccctacgtgtaagttcgcatgtttctcacggccatctctttcacactcncagtcacaggacccggaaaggcaacgcttt

SEQ ID NO: 55499 - DNA, 101 bp, rice(Oryza sativa)
  misc_feature (71): n=t or c
ggagaaagtcttagccagctcatactccttacgatattagtgtactattaaggaaaaacaaagaatagcangggattaactgagatactgtaacgtcccgc

SEQ ID NO: 55500 - DNA, 101 bp, rice(Oryza sativa)
  misc_feature (71): n=a or c
gttacttttttaagtagagtgcacggacagagtttaaacttgtatttcttgaattcttaaaatgcatgttnaggtttctgaacttgtcatgtgtgttatat

SEQ ID NO: 55501 - DNA, 101 bp, rice(Oryza sativa)
  misc_feature (71): n=t or c
gcccacatggccatctatagttagtgctaataggaattgagatatgtggtcttgtaacagcaaggtattanttttacagtgcaattagctctgttcttttc

SEQ ID NO: 55502 - DNA, 101 bp, rice(Oryza sativa)
  misc_feature (71): n=t or c
cacgccaagctaggttcgttattaagcccgtacaccccatacttcccatccatccatcaatttatgtttcntggaccttgacatgtcgatcgctgctgcct

SEQ ID NO: 55503 - DNA, 101 bp, rice(Oryza sativa)
  misc_feature (71): n=t or g
tagtagaaatgcactgtaatttttgtgcgtgtgtactaggaagggattaggaactaattgtgcaaactttntgctattttgtgacaatttaacaatatttg

SEQ ID NO: 55504 - DNA, 101 bp, rice(Oryza sativa)
  misc_feature (71): n=a or g
gtatactaaggaagaagtcagtggaagtgagctcgtaactaagacttccataatagaaggcaaagaagtcnacgaacgaagcagcttttctaataacccag

SEQ ID NO: 55505 - DNA, 101 bp, rice(Oryza sativa)
  misc_feature (71): n=t or c
atcgatcgagacggtttaatttcgcagacgccaaattattcaagtcaagtccacgctattcatggtccatntagttataactagatgctgaaacttaatta

SEQ ID NO: 55506 - DNA, 101 bp, rice(Oryza sativa)
  misc_feature (71): n=t or c
cgttggactatgtcgttgattgattcagcagcgagaccatttggtttcgctctttcattccgcaagatcgnggtggtctcgcatttttttcacgcgatacc

SEQ ID NO: 55507 - DNA, 101 bp, rice(Oryza sativa)
  misc_feature (71): n=a or g
tcatcttcaccaggcttgccttggcgaagagcgcgaattggaattcaggccctgcagctccgtgctggtcntacctgtaggacctcgatgacgccgcttgg

SEQ ID NO: 55508 - DNA, 101 bp, rice(Oryza sativa)
  misc_feature (71): n=t or c
aggatatatttctattgcgccatttatttttctttggcttttattattagggttaagtccgatttaccccnctaaactcttgcgaaagtacgttgtacccc

SEQ ID NO: 55509 - DNA, 101 bp, rice(Oryza sativa)
  misc_feature (71): n=t or c
taggagcatgtagaaactgacataccttatttactggaaagtaaatgtctggtctagtcagagttaagtantggagtgctcctactacacttctgtaatta

SEQ ID NO: 55510 - DNA, 101 bp, rice(Oryza sativa)
  misc_feature (71): n=a or c
ctaaaaaatgtttctgtcgttttgaaatgccttaacacgtgtaattttcttgtgtgttcaagaaatctttnttttttaacaaaatgtcaagaagtaactac

SEQ ID NO: 55511 - DNA, 101 bp, rice(Oryza sativa)
  misc_feature (71): n=t or g
aatgcaatgatttattagatcatgtttgagacgatataataatttaagcatagtgccaaatgaaagtgagngaacatgtaagcatattgtttgggagaaga

SEQ ID NO: 55512 - DNA, 101 bp, rice(Oryza sativa)
  misc_feature (71): n=a or g
ggaaggtggaggaacaatatgggaaaggaggcagatggctgggcatgggagctcattctcgggagaagcangagaggtggctggagcttacacataattgt

SEQ ID NO: 55513 - DNA, 101 bp, rice(Oryza sativa)
  misc_feature (71): n=t or c
ggagtatgttgttctttataatgtcatgcacttgcatctaaagctgaacaataatcaattatatgcataantatgtcatctgatataagatcggtttaaga

SEQ ID NO: 55514 - DNA, 101 bp, rice(Oryza sativa)
  misc_feature (71): n=a or g
tgcatggtgatgggctagctacctcatggtggccaaaggctgaggttttgggctatatgatatactatgtnacaataatgtcaaatattaattcacaaaat

SEQ ID NO: 55515 - DNA, 101 bp, rice(Oryza sativa)
  misc_feature (71): n=a or g
gtaggacagacgtgtaatgtaggccggaactcagtaagaactgaggaaggcatgccttccacacgcaccgncctcaaatcccccacttcaccagcatcccg

SEQ ID NO: 55516 - DNA, 101 bp, rice(Oryza sativa)
  misc_feature (71): n=a or g
cctaagatggagaacaagagggaaaaaaaggtggggcagtggaggtgcctaatattagtgattccattggntgacccttggaaagcatttttcttatttat

SEQ ID NO: 55517 - DNA, 101 bp, rice(Oryza sativa)
  misc_feature (71): n=a or g
tgagggcctagagtcgcccatgtaataaagtgcttcctttacgttttcgcatgtgtggcttgtaataatcnacaatgtctatgtgtacctcgcctcttggg

SEQ ID NO: 55518 - DNA, 101 bp, rice(Oryza sativa)
  misc_feature (71): n=a or c
gctgtcaccggtctaaccgccttgctcccgctggtctgatcagagcacggtatcccactggtataaccacnggacccaagcaaacataattaaagatatct

SEQ ID NO: 55519 - DNA, 101 bp, rice(Oryza sativa)
  misc_feature (71): n=t or g
tatgccattagtgcattaattcctctgtcactcgtgccttacggtgatatgatcaatgatctctaatctgntactaagcttaattcctttaccatttctgc

SEQ ID NO: 55520 - DNA, 101 bp, rice(Oryza sativa)
  misc_feature (71): n=t or c
gtgctggacgcaccgtgtcttctcgggcccggccaagcgacgtgacaatcaatcccatttcttgacagccnatgccccggtaattcaggagtgttgatggc

SEQ ID NO: 55521 - DNA, 101 bp, rice(Oryza sativa)
  misc_feature (71): n=t or c
taagagatccgagagatttacaattttcactgactggttcttcattagtgatatgggcatagatctttgcnatgcatcatcagaacaactgcgcagtaagg

SEQ ID NO: 55522 - DNA, 101 bp, rice(Oryza sativa)
  misc_feature (71): n=t or c
attttaaatagcatctctgcacaaactgtgcatagctgatcatctgaatgccttatggccctattgcaggnattatccagaaggcaaggataattacggag

SEQ ID NO: 55523 - DNA, 101 bp, rice(Oryza sativa)
  misc_feature (71): n=t or g
atctctaagtgaggtgcggttagataccccgatttggattattggagtagtatttcttcactgaacttgtnacttcgataatctactgttgtggtaggaga

SEQ ID NO: 55524 - DNA, 101 bp, rice(Oryza sativa)
  misc_feature (71): n=t or c
caagagtaagcagctctctttgatcctttttgtaatcacttcattttttcggccgattactcacagacttnatagttgcagaagaagaaaattgctgtgaa

SEQ ID NO: 55525 - DNA, 101 bp, rice(Oryza sativa)
  misc_feature (71): n=t or c
gttagctacacatagacacagttcattcgtttgagtcggccatctccatttcctttttccattttacttanctatacgaccatacagtatacactatacac

SEQ ID NO: 55526 - DNA, 101 bp, rice(Oryza sativa)
  misc_feature (71): n=a or g
actgaaaccatagatttgaagtgatagaaataggaaaatagcagtctgggcaatgatcagtcattgattcnatgcttgtcttatttcaatatgtaacagat

SEQ ID NO: 55527 - DNA, 101 bp, rice(Oryza sativa)
  misc_feature (71): n=t or c
cgtctgcctgttttttctgaaagtgatctgcccgacggcaaccaccacttgcattgcaatgtgttaatgcnagcaatatcaatttttctgggttctgcaaa

SEQ ID NO: 55528 - DNA, 101 bp, rice(Oryza sativa)
  misc_feature (71): n=t or c
aattgggcacctggctgcagggctacaactgaaagtgagttgtgtagtgtaggttcagtactttgcagtcnttaaatgtttgtcgagcagttcaaaagaga

SEQ ID NO: 55529 - DNA, 101 bp, rice(Oryza sativa)
  misc_feature (71): n=t or c
accggatcgaaaaaggagagaagcaagggcatagtgggtaagaggacgatgccatgatcgtgaaatggagnggtgatgcttgtcgaggaccgagatatgac

SEQ ID NO: 55530 - DNA, 101 bp, rice(Oryza sativa)
  misc_feature (71): n=a or g
ataaatcctactaatttttaccaacatctagtttcgggtggatgccctaaccatttatgaaaagaaattcncgcacggatgctctaccacccgtatggacc

SEQ ID NO: 55531 - DNA, 101 bp, rice(Oryza sativa)
  misc_feature (71): n=t or c
aaccaccatgttaactaatcgattaaaaatctacgaataaccaacttagtatgtagcagtctattctcttngctttccgtatcatataaaagatcgttatt

SEQ ID NO: 55532 - DNA, 101 bp, rice(Oryza sativa)
  misc_feature (71): n=a or g
atgttctgttgatttttcagtttaatttttttccagcagtccacatatatatctgtaagcactaagcatcncgcagatgtcttaaattggtttattttctc

SEQ ID NO: 55533 - DNA, 101 bp, rice(Oryza sativa)
  misc_feature (71): n=t or c
aacttggaactttccttcaaaagagaattgcttagaactgaacataacatagaagagatgttttgcgaganaatgaagtttggcctttctctgcgacccca

SEQ ID NO: 55534 - DNA, 101 bp, rice(Oryza sativa)
  misc_feature (71): n=t or c
gatttacttctgtcacaagttcagttattctcttaattatgtatacaaaacgttcggaattttagttacancacgcaatcagccagaccagcttatggcag

SEQ ID NO: 55535 - DNA, 101 bp, rice(Oryza sativa)
  misc_feature (71): n=a or g
tatgtgctcctaaatattccattgctattacagcagcaaaagggcatcatattaagaggtaaacagaacantgcatcaacttgttcacgacataccgttcc

SEQ ID NO: 55536 - DNA, 101 bp, rice(Oryza sativa)
  misc_feature (71): n=t or c
tgcaaggatgggaggagggggaggctacgacatcaactcggtctggaaagtcgctgacttggcgctgcatngcaagcgagaggtctccagggagcggccta

SEQ ID NO: 55537 - DNA, 101 bp, rice(Oryza sativa)
  misc_feature (71): n=a or g
cgtgctctgcggctctgctacctcgacatcaacttcccgactttggctatatcgaccacagctactctacncacgacttcatcgaccacggctctctcgca

SEQ ID NO: 55538 - DNA, 101 bp, rice(Oryza sativa)
  misc_feature (71): n=t or c
cgcggcatccgatccgaggcgcgcgcggccggaaatttttttgaaaatatgccgtttatttttttttcttncagaaatattcggattgtaattttgtttgt

SEQ ID NO: 55539 - DNA, 101 bp, rice(Oryza sativa)
  misc_feature (71): n=a or g
gctcctgcgacgtgggcggatgaggcggtttggcgccgatttcgcgggagagtgggggggaattggtggangaggtggaggggaaccaattccacatggtt

SEQ ID NO: 55540 - DNA, 101 bp, rice(Oryza sativa)
  misc_feature (71): n=a or g
gatgcagtatcttaaaaaggtcttggccatatatataacggtagtagaaagacatggagggtattttagtnctaatcggtgtaggaaatggaggcaccagg

SEQ ID NO: 55541 - DNA, 101 bp, rice(Oryza sativa)
  misc_feature (71): n=a or g
ttgcctacagttgccatgacgatggggaccgtgttttccttgaaccagatcttacatgttgagaacgacanttgtgcactcaagttcctgtgccacttatg

SEQ ID NO: 55542 - DNA, 101 bp, rice(Oryza sativa)
  misc_feature (71): n=t or c
aaaaccattttcccagatgatgacatttttttctaagtaggtaggcctctcggagctaaatggccacctgnaaaaataacaaccgtgggcgatatcgttgt

SEQ ID NO: 55543 - DNA, 101 bp, rice(Oryza sativa)
  misc_feature (71): n=t or g
aattttgggtttaaagtttaaaggctgttgagatttttgcatgctataagctagcttagtgattcctttcnccttcttccatttccagtgtaacctttttt

SEQ ID NO: 55544 - DNA, 101 bp, rice(Oryza sativa)
  misc_feature (71): n=t or c
atctaggcggttgaagctgacatcaaggacgacgatgctgctagtggatatcagctctgatggaagcccancggagagcaagttgtacgacaggttgagtc

SEQ ID NO: 55545 - DNA, 101 bp, rice(Oryza sativa)
  misc_feature (71): n=a or g
ggcgatatcggcgtgtgggtggtggtttttttttcctttcctggttatgactccccaggattgtaatcttntacttttttcctgctctatcaatagaactt

SEQ ID NO: 55546 - DNA, 101 bp, rice(Oryza sativa)
  misc_feature (71): n=a or g
cgtttctagaaacagaggcaagaggcttggtagcatggtgttggctccggcgatctctagtggatgagtcncctccccctcgtccattacctcctcaaact

SEQ ID NO: 55547 - DNA, 101 bp, rice(Oryza sativa)
  misc_feature (71): n=t or c
taaaagtgattttcgtatgcggatcttccaaccgtctggaatgaagtatctgtaaaaatcgctatttttgngtgtgggtggcgcacccacaagcgaaaatc

SEQ ID NO: 55548 - DNA, 101 bp, rice(Oryza sativa)
  misc_feature (71): n=a or c
gcaggtccggtggccgcccgggcttcgttgttgccatctttactgtcgaaagccatcaaaatctataaaanttagtcgatcatagtaaaatatcattagct

SEQ ID NO: 55549 - DNA, 101 bp, rice(Oryza sativa)
  misc_feature (71): n=a or g
tatacgaacgaacgatagaatgttccagaaggtgtagactccaagaaaactaatgaattgttggtatatantttctctcgtccatagttggcttgggcctc

SEQ ID NO: 55550 - DNA, 101 bp, rice(Oryza sativa)
  misc_feature (71): n=a or g
aaaggtggttcgggaagctgcctggtgggtccttgcggcagtgcacggtgattagcccttgaatatgtcanttatgcactgatttgtgggccctccaatat

SEQ ID NO: 55551 - DNA, 101 bp, rice(Oryza sativa)
  misc_feature (71): n=t or c
ggcctgcttgtcattgctacccctctcccctcggtgacgtcataaatgactttaaattgcgcaataaattnagttaataattatagaaatttatttgatgg

SEQ ID NO: 55552 - DNA, 101 bp, rice(Oryza sativa)
  misc_feature (71): n=a or g
gtttctctgattccttgcgaaaataagatctgcaatattgtgtaatctgaaatcgtgatgttcaaatctgnaatgtggggcctgttcactttgatgccatt

SEQ ID NO: 55553 - DNA, 101 bp, rice(Oryza sativa)
  misc_feature (71): n=a or g
aggatttcctggtgtactgtgacgcttcgtgccaaggtttggggtgtgtgttaatgcaagaaggtcatgtngtagcttatgcttcacgccagctacgaccc

SEQ ID NO: 55554 - DNA, 101 bp, rice(Oryza sativa)
  misc_feature (71): n=t or g
gtaattttggcaaaaaaaacacgcgaaaaaaaatcgctccgtaaagaaagccaaagaaaaacaacgaaaangtgtaaaaaaaaaagagaaacagcgaaaaa

SEQ ID NO: 55555 - DNA, 101 bp, rice(Oryza sativa)
  misc_feature (71): n=a or g
tgacgggtctcccaacttacgaaaccagtacaaacaagatcccttgatagtattgtccctggttttggctnacgtggcgcctatgtggctcatttggcttg

SEQ ID NO: 55556 - DNA, 101 bp, rice(Oryza sativa)
  misc_feature (71): n=a or g
acatataatgtctcgcctgtaaaaatcgaggtccgcctgtaaaagtaatggtattcaattttcacatgcanacaatgatctcgtctcacggttgtcatttt

SEQ ID NO: 55557 - DNA, 101 bp, rice(Oryza sativa)
  misc_feature (71): n=t or c
ggaagaagttacaactgccagaagctcctaaacaagcccctagactagaactaaagattttggaagaaacnatatttgctagaagctctccaaacatgatc

SEQ ID NO: 55558 - DNA, 101 bp, rice(Oryza sativa)
  misc_feature (71): n=a or g
ccaaaattaccaaaatttgacattttagtgtgattaaaaatgacagcataaactaaaccggatctagtatncaactcaggccctgtttagttcccaaacaa

SEQ ID NO: 55559 - DNA, 101 bp, rice(Oryza sativa)
  misc_feature (71): n=a or g
gccggggacgcaaatgtatcgagaagaagtgctatcatgcggatgacgagatattaaaaaacaaccgacgnaaaattaatcccgatggaaataaatctcta

SEQ ID NO: 55560 - DNA, 101 bp, rice(Oryza sativa)
  misc_feature (71): n=a or g
attacgtttttaagatgcaccatgagaaatgctttcataacatacaatttacgtgttgttaaatgggagtncctatacatctttcaaaagatttttatgat

SEQ ID NO: 55561 - DNA, 101 bp, rice(Oryza sativa)
  misc_feature (71): n=a or c
atctataaaaagtaagtaaatatttatcttttaaaagtactttttataagactaatctgtacatcgtggtntggtgtctttaaactaaatgttctaaaagt

SEQ ID NO: 55562 - DNA, 101 bp, rice(Oryza sativa)
  misc_feature (71): n=a or g
gccggcgacagaagcttagggatagtgtcatctctggtgagcagacgaaagcacgtgacacggtgctgtcngcactgctccaggaggatttgggtcccgca

SEQ ID NO: 55563 - DNA, 101 bp, rice(Oryza sativa)
  misc_feature (71): n=t or c
acttatgtccatattatcagaagaagctctgctctgaattttgagagttgcagtaagacagaagtatatgntgtgaagattcactttagagcttaggtcat

SEQ ID NO: 55564 - DNA, 101 bp, rice(Oryza sativa)
  misc_feature (71): n=t or c
aaattcatcatccatttttccctttataattgatggctcaactctcttctcttttattttgtctttttctngatgcaataaccattgttcactggatgatg

SEQ ID NO: 55565 - DNA, 101 bp, rice(Oryza sativa)
  misc_feature (71): n=a or g
acaatagatttaataataaaattatcacaaagggtttaaatccatagcactaatcactaatgttaagtttncgttataaatgtccaaattttgtgactaaa

SEQ ID NO: 55566 - DNA, 101 bp, rice(Oryza sativa)
  misc_feature (71): n=a or g
ggaggagcgtgacgttcaaatcggagggctggatggcaccgtcggacggatgggattgagccacgtaggangaatcgacggctgcggattaatcaggttcg

SEQ ID NO: 55567 - DNA, 101 bp, rice(Oryza sativa)
  misc_feature (71): n=t or c
tttacaattgggattcgtccaaataccactttcaactcggaccaacccgctgaaatgccattttcttcatntgtagtaaatcaaaatcattttgtcccttt

SEQ ID NO: 55568 - DNA, 101 bp, rice(Oryza sativa)
  misc_feature (71): n=t or c
ccatgtgatctgcttgactgtctacatctcaacttcttccaaatctagttccgatccatcactagtaatantcccatggcctcaagcaacacttccacatg

SEQ ID NO: 55569 - DNA, 101 bp, rice(Oryza sativa)
  misc_feature (71): n=t or c
caggaatgattctcatgtatggggtcattttaaattgtagacggaccgtaagtggtcgcgttgtgattttnattttcacatgcaactctttaaaatgaccg

SEQ ID NO: 55570 - DNA, 101 bp, rice(Oryza sativa)
  misc_feature (71): n=a or g
cgtcgacgccgcgacaccaggaggaaggagatggacgagctccacccgcattccatgtcagcatgtaggcnatgtcttccctctgcgcaagcccactcctc

SEQ ID NO: 55571 - DNA, 101 bp, rice(Oryza sativa)
  misc_feature (71): n=t or g
cgctggctacgaggatggaggacgcaagttaataatttcgatcgtccgagaccggtaattagctcacttcnttttatagcttcgtttcatgctataagtcg

SEQ ID NO: 55572 - DNA, 101 bp, rice(Oryza sativa)
  misc_feature (71): n=t or c
gcatttctgcaaacagaagcagggcatatagatcaaaagaaccaccattttctcacctctctctctctctngctcactctttgttggtgattcttgaagct

SEQ ID NO: 55573 - DNA, 101 bp, rice(Oryza sativa)
  misc_feature (71): n=t or c
attctgttagacatgggtgagtttgttatttaggattcttgcatttctttaggcttaagcaggttatgtgnatctttaaatagagatcaatgtaatcagtt

SEQ ID NO: 55574 - DNA, 101 bp, rice(Oryza sativa)
  misc_feature (71): n=a or g
taagaatccatgacttgtggaggtggcatgccatccccatcgcagaaaaatggtctcagaggcacttgcancgcatccacacccccttcgagcatctctat

SEQ ID NO: 55575 - DNA, 101 bp, rice(Oryza sativa)
  misc_feature (71): n=t or c
ccatgttcaaacatacaaggttacagactagtactagttaattatgaaagcattataggttgtgtacatcntttgtgtgtagaggccggtttaattcatta

SEQ ID NO: 55576 - DNA, 101 bp, rice(Oryza sativa)
  misc_feature (71): n=a or g
ggttacaaggggtcattctcaagattatccatgtaaatcagtatgggttcatcaagggcagaacaattcangattgtttggcttggtcttttgaacatata

SEQ ID NO: 55577 - DNA, 101 bp, rice(Oryza sativa)
  misc_feature (71): n=t or c
gcagtgagagtagctcgatctatctatatatagagccaaattattaattatgcaaacgaactaaagatagntgaatagagtacaatactccctctatactc

SEQ ID NO: 55578 - DNA, 101 bp, rice(Oryza sativa)
  misc_feature (71): n=a or g
ctataaaaaaaaattaaaggaaaggaaagagaaggtaaggagggccggttgcgtgcatgcagtatgaagtnatattttttaagggttaattggatctatgc

SEQ ID NO: 55579 - DNA, 101 bp, rice(Oryza sativa)
  misc_feature (71): n=a or g
tccctacaaatgttaaacatataacgaaaatcatgaatctaaaagcaatctcttaagcttttttaaaacgngcgatagtatcctcttgttgtatcaaaggc

SEQ ID NO: 55580 - DNA, 101 bp, rice(Oryza sativa)
  misc_feature (71): n=a or g
gcccatcttcagttaccagcacctcttgaactgtccaggccggctcccttgatggcccgtcgtcggtcgcnatcgcgccaatgctagccgagtcgccccgc

SEQ ID NO: 55581 - DNA, 101 bp, rice(Oryza sativa)
  misc_feature (71): n=t or c
ttatatattattgtcgaaggttaggtttacagatcgatatgtgccgccttcttcgtacgctgctgtagctngtcgttcaatggagagaaagaaccaggtcc

SEQ ID NO: 55582 - DNA, 101 bp, rice(Oryza sativa)
  misc_feature (71): n=t or c
tatcccaaccagctagactacaacggattttgctagctatatttcttagacatttattgattatattttgntgtgtgttatggagcttatttagcccaaaa

SEQ ID NO: 55583 - DNA, 101 bp, rice(Oryza sativa)
  misc_feature (71): n=a or g
cgggacatcgatgtggtggtcctcatgataccgcgccttgagatacttgacgtcgcgagccgttttcttcnccgcattccgcaatcggcggttctttttgg

SEQ ID NO: 55584 - DNA, 101 bp, rice(Oryza sativa)
  misc_feature (71): n=t or c
aaagatggttattaatgttgggaacaatgctgtgaattagagctagataatgagacttcactgagaactcnccatttgaggttaagttccaatgaaactca

SEQ ID NO: 55585 - DNA, 101 bp, rice(Oryza sativa)
  misc_feature (71): n=t or c
ggaggccagccagccagccagccactgaagaagctgtagctgctgctgctgctgctagtgccaatccttanggtccatgagcaagcaagcaacaaccatca

SEQ ID NO: 55586 - DNA, 101 bp, rice(Oryza sativa)
  misc_feature (71): n=a or g
gaggtgtgaccctatctcctctcaagactcacatgagctttggagcaaaagaacatggcctagaatctagngcactcttaaaaatctaacctattagtttc

SEQ ID NO: 55587 - DNA, 101 bp, rice(Oryza sativa)
  misc_feature (71): n=a or g
ttcactgaaaatctatagtgctaatgtttggcttaacctcacagcaagggcggagacaacatgggggcggnggggtctttagacctcccccccacccctaa

SEQ ID NO: 55588 - DNA, 101 bp, rice(Oryza sativa)
  misc_feature (71): n=a or g
tacaaccaaccaaacagctgcatgtgtatctacttggccaggctaaactcggtctggacgagagagatggnccaggctaagaagatgcgatcaaccaaaac

SEQ ID NO: 55589 - DNA, 101 bp, rice(Oryza sativa)
  misc_feature (71): n=t or g
acttcacaatggtataataaaagaagaaaaaaaaggttaaacagagaaggaatgaaacaaggcctgttatnggccagcccattttgctcctccgaagccaa

SEQ ID NO: 55590 - DNA, 101 bp, rice(Oryza sativa)
  misc_feature (71): n=t or c
tagaggaagacaggagggatgcgagagagctgacaatataatgtgccatccatccctcgtcttcctccccngatgtgccgtcattgtccgccacttcgatg

SEQ ID NO: 55591 - DNA, 101 bp, rice(Oryza sativa)
  misc_feature (71): n=a or g
gatttgatttatgaccaacggtgaagattatcctatctatttaatcaaaggacacattttcctacttaacntgggactcgtagaaagtgacctagtatagc

SEQ ID NO: 55592 - DNA, 101 bp, rice(Oryza sativa)
  misc_feature (71): n=a or g
tagcaccgaaatgcttaacgaaacggacggagaggggagaggtcaaggaagggacattaccctaggtggcnattctgtaaaaactactgggtttgagtatt

SEQ ID NO: 55593 - DNA, 101 bp, rice(Oryza sativa)
  misc_feature (71): n=a or c
gtgcaatagactagaagtttacagtgatcggagtccggatgaagtaccggggatcgaattaatatgggccnttcgatctttattagcatctctgtttaatc

SEQ ID NO: 55594 - DNA, 101 bp, rice(Oryza sativa)
  misc_feature (71): n=a or g
ttgttggcatgtcccgcctcctccaggaacccgacctcgctaacctcccctacctccggtgcatcatcacngagacgctccggctgtaccctctagccccg

SEQ ID NO: 55595 - DNA, 101 bp, rice(Oryza sativa)
  misc_feature (71): n=a or g
acagtgaacaggggaataggaaaaaaatgggtagaacaggggaaagcagagagaaacaggggaagaacagnggaaaacagaggaaaacaggggaacccaag

SEQ ID NO: 55596 - DNA, 101 bp, rice(Oryza sativa)
  misc_feature (71): n=t or g
gagatttagtggattgaaggaggcagctgggcgattgaagacggcctgaaggttgatgaagaaggattttngcgcttccgccaccaaaactttggttttac

SEQ ID NO: 55597 - DNA, 101 bp, rice(Oryza sativa)
  misc_feature (71): n=t or c
ttgatccttcctcccgcgcctgagcctgatgacgaatactctggcgtgacattcctccctccttgagaacnagcttgaccccaagctagtgcagctggaaa

SEQ ID NO: 55598 - DNA, 101 bp, rice(Oryza sativa)
  misc_feature (71): n=a or g
caattgactgatatgtcaatttcgttacttttttggaacgagacagaaaccgcgatgttatgagatagagntccgacatgactcatgagtgtcatcagcaa

SEQ ID NO: 55599 - DNA, 101 bp, rice(Oryza sativa)
  misc_feature (71): n=a or c
aattagcactagaaaattaattagatgtttatttttttttaaccagggtgcaatcaccgtatttccattantagaaatgaacagtagctacaaacaagtct

SEQ ID NO: 55600 - DNA, 101 bp, rice(Oryza sativa)
  misc_feature (71): n=a or g
aggttttaagggtgttctagccatgacacatttttacggtttctaccagtaaaatgcacaaatttgaaatntcctgtagcaaaatttaccttagtggtatg

SEQ ID NO: 55601 - DNA, 101 bp, rice(Oryza sativa)
  misc_feature (71): n=a or c
cattagaaataatccacacggatatatgtggactgttcctagtaacatatgttgatggatatgattcattnattaccttcacagatgatttctcccgttat

SEQ ID NO: 55602 - DNA, 101 bp, rice(Oryza sativa)
  misc_feature (71): n=a or g
catcgttcgccggcggcggcgaggccttcaggttaattgggctgctgtagatccggccccgctgtcgccanatctatgacggcgatgtctggaagcgtgtt

SEQ ID NO: 55603 - DNA, 101 bp, rice(Oryza sativa)
  misc_feature (71): n=a or g
tcccgtgaacaatattaataaattaatcaatgtacatgttgaaatgttttggacaaagagaatagagaaanaaatgtatatgtacaactataatataaaca

SEQ ID NO: 55604 - DNA, 101 bp, rice(Oryza sativa)
  misc_feature (71): n=t or c
tccccctctctctcatcctccatccacctctctctctctcccccacctaatggcggcgcgttccccttcgngaagatctggcaggaggggaggcacgggct

SEQ ID NO: 55605 - DNA, 101 bp, rice(Oryza sativa)
  misc_feature (71): n=t or g
ggtagtgggtcttgccggcgacggcagcaaaggtgccctccgacattggcacgatcttggatggctcctgnccggggcatggctcgttggtggcgctgtgg

SEQ ID NO: 55606 - DNA, 101 bp, rice(Oryza sativa)
  misc_feature (71): n=t or c
tcaccacgcctagtgtcagttaggcagcaccattagcagcgcgtcgtgcatgtcctgccggtcatgcccgngccgcacgtccctcctctctatctcaatct

SEQ ID NO: 55607 - DNA, 101 bp, rice(Oryza sativa)
  misc_feature (71): n=t or g
cagcatcttcagtaaaagagcctctgtgcactgcgagatcttagaattctccacggagattttacgatgcnaattatggtggctcagtaattgggacgctg

SEQ ID NO: 55608 - DNA, 101 bp, rice(Oryza sativa)
  misc_feature (71): n=a or g
ccatcccataaagatttcattttttttctttttccaacacttgactacccatcttacttaaattttttatngattttttatatagtcgcatataaagtgct

SEQ ID NO: 55609 - DNA, 101 bp, rice(Oryza sativa)
  misc_feature (71): n=a or c
cgtagctgagtcggtcgacccatcccgcctaatgggtagattcgcccctggtttaatttagacatctaatntggtcaaaaaaaattgtttgtttttagata

SEQ ID NO: 55610 - DNA, 101 bp, rice(Oryza sativa)
  misc_feature (71): n=t or c
tcggccactgggccaaggactgcaggagcaagcccaagcaggagcaggcacatgtggtccaggaggaggangagcccacgctcatgctcatgacgggtggc

SEQ ID NO: 55611 - DNA, 101 bp, rice(Oryza sativa)
  misc_feature (71): n=a or g
tcccataaaaaattaacttctgaggatgaatctggataaatatttgtttaattttttttttgttgtggtangagcaggagtacttgtgtgctacaatgtct

SEQ ID NO: 55612 - DNA, 101 bp, rice(Oryza sativa)
  misc_feature (71): n=a or g
acgaaactttgggacgaaatgaccttaatccttgtctataaaggaaaaacgtccctccaaacatttttaanaagaaattttaagcgtattgagaattgaac

SEQ ID NO: 55613 - DNA, 101 bp, rice(Oryza sativa)
  misc_feature (71): n=a or g
ctaaccatccagatatgagtgagagaagggagaatagaaagagatactactggagaaaccatctttcatcngtcgaccaaattctacaatagttccggttg

SEQ ID NO: 55614 - DNA, 101 bp, rice(Oryza sativa)
  misc_feature (71): n=a or g
aggccagaccatgacttatgatcgccaaccaacgaattttttttaaactaaggcaattcgatatgtgcctncgagcactgtagcatcactgtagcgcactg

SEQ ID NO: 55615 - DNA, 101 bp, rice(Oryza sativa)
  misc_feature (71): n=t or c
atgtaggccaaacacagttgtgacagagtgaagtttgtgatgttttttaataccaagtataagtgaggtcntaaggttgagtattatccaagacttagtaa

SEQ ID NO: 55616 - DNA, 101 bp, rice(Oryza sativa)
  misc_feature (71): n=a or g
acgttgcgatgatggctagagaaaccgttgtgtgttttttttttcccctttcttcctttcgcgctagtacntttgtttattgtaaagtgcgggccactctg

SEQ ID NO: 55617 - DNA, 101 bp, rice(Oryza sativa)
  misc_feature (71): n=t or c
gtttgccctttctgtgttctgaaccactctggcatgtcatacaattctgaaccgctcttggcatgtcatanaattctgaaccgctcttggcatgtcacata

SEQ ID NO: 55618 - DNA, 101 bp, rice(Oryza sativa)
  misc_feature (71): n=t or c
cttgggttccaataatgcacgtatcgacggattaagtcgtgcatatgaagtcaatcagcgttccgaacttntgatggcccaactcacatgatgttattatt

SEQ ID NO: 55619 - DNA, 101 bp, rice(Oryza sativa)
  misc_feature (71): n=a or g
tctcctcctttagccctcccttccgtaatatctggtatgcatggcatacatcagcctgcaaagtgcaaacncacccaaaaaaaaaaaaacatcaaacctca

SEQ ID NO: 55620 - DNA, 101 bp, rice(Oryza sativa)
  misc_feature (71): n=a or g
aaaaagaatcttctttaatagactcatacatggaaattatgctaataaattcgttatataagctattctcntaatgttgcacttccataatttgaagagaa

SEQ ID NO: 55621 - DNA, 101 bp, rice(Oryza sativa)
  misc_feature (71): n=t or c
ttgatatatagaatgattaagcctctgatgaacgcatttgtttggtgcatgcagatgcgagacacatctancgtgggcatagatggtgctgacaacagaac

SEQ ID NO: 55622 - DNA, 101 bp, rice(Oryza sativa)
  misc_feature (71): n=a or c
cggcagattggattctattctaaaccccagctaatacgccacgccaccactcggagccaagccctaggctnctcctctcctcccaatccccaatccctgtt

SEQ ID NO: 55623 - DNA, 101 bp, rice(Oryza sativa)
  misc_feature (71): n=a or g
caaacaataatactacttaggtcctgatggtttcaacttaagattattcattatcgtaatctagattattnaagattactgtaaactggattataataagc

SEQ ID NO: 55624 - DNA, 101 bp, rice(Oryza sativa)
  misc_feature (71): n=a or g
ggagaggggagtaaatgacaatagtcagttagatgtgggtcccacatactctctctgtttataaaaatttnataatgttaactttttagcacatgtttgac

SEQ ID NO: 55625 - DNA, 101 bp, rice(Oryza sativa)
  misc_feature (71): n=t or c
gtggtgatattcattgcgcactacggccgcgctgctctctttaaaaggagtataatatagaacaccgctgntgtgcacgctgtcatgtccatgcgacaacg

SEQ ID NO: 55626 - DNA, 101 bp, rice(Oryza sativa)
  misc_feature (71): n=t or g
caactgaggggatgatggccggacggcgaactcaccgaggcacggctgttggagcgaactaatccggaggnggtcaggactattttgcgccgccgcggagg

SEQ ID NO: 55627 - DNA, 101 bp, rice(Oryza sativa)
  misc_feature (71): n=a or g
acagatacaaacataaattttgcataattcaccataagttaaataagcacttgcttcggtcacgcttcatngcttcaagccgtgctagtagtgatacaggc

SEQ ID NO: 55628 - DNA, 101 bp, rice(Oryza sativa)
  misc_feature (71): n=t or c
tctcattttcaaaacatcaagggtcagaatttggaaagttgtcctctaaattataaaatttattatcattntgccattttttatcctctatatattacgat

SEQ ID NO: 55629 - DNA, 101 bp, rice(Oryza sativa)
  misc_feature (71): n=a or g
ctctctttctcatcctctctctcacttttctcctctctgcacggtgctgacaggtagggaggaggttgccngggcaaggtgagcgaggagatccggcagcc

SEQ ID NO: 55630 - DNA, 101 bp, rice(Oryza sativa)
  misc_feature (71): n=t or c
cgctaatggaaaagggtaaataaaaggagcaagctggtgagcaaactatttttttttaaaggaacaacggnagaagatctgccggaatttaattaagggga

SEQ ID NO: 55631 - DNA, 101 bp, rice(Oryza sativa)
  misc_feature (71): n=t or g
tcatgtgttccgttgcatgcatatatgcgagtggcctcacgtcattcattcaagcaacaatcatgtgcacntgctttcaaatacaagtggggtgtttagat

SEQ ID NO: 55632 - DNA, 101 bp, rice(Oryza sativa)
  misc_feature (71): n=a or g
tggcccagtagcatgttttgggccagacttgtccgcgggcttgatttttttagcaaaaattgaaggaaacntgcgcgcttgtggggagtcgacccctggtc

SEQ ID NO: 55633 - DNA, 101 bp, rice(Oryza sativa)
  misc_feature (71): n=a or g
ccatttccacgggtgagtttcgtcccatatcgtcctgcgacataggcgtttgaagggtaatcgccggggcnaccaccggtaacttgggctgcccacgctgc

SEQ ID NO: 55634 - DNA, 101 bp, rice(Oryza sativa)
  misc_feature (71): n=t or g
cctacataattaaccccgtgtaaaactagatactaaagttcgtaacgaatgtttaggtatctaaacgttcncaagtataaaatgtttaaactaacatgttg

SEQ ID NO: 55635 - DNA, 101 bp, rice(Oryza sativa)
  misc_feature (71): n=t or c
ccggatgtggcgtgtacatttattcgtcaatacaataggcaacaatattgtaccaatgtcccaattcacangacagcacacatcacatcggaatatcatgt

SEQ ID NO: 55636 - DNA, 101 bp, rice(Oryza sativa)
  misc_feature (71): n=t or g
cttgctcgactcttgggacaatgatttatatagctgaaaagtttagtccggctttatatttttgtgcaaangaaaatcgatatcaatgtcatcacatgtta

SEQ ID NO: 55637 - DNA, 101 bp, rice(Oryza sativa)
  misc_feature (71): n=a or g
caagcgtttgcctggaaacgtggtccaaacaatgttctactacaaattacaaccaaaataacaataataanaatggacctatctaagaccaagtttaatag

SEQ ID NO: 55638 - DNA, 101 bp, rice(Oryza sativa)
  misc_feature (71): n=a or g
tcgccgatctatccttgagtccttgttggtggacgccgggattagcacgatcttccgactaacactggtgnagaaaccatctttcgtcggtcggccgattt

SEQ ID NO: 55639 - DNA, 101 bp, rice(Oryza sativa)
  misc_feature (71): n=a or g
actaagagctagctaggctttcgggtttcaatttttgggattttttttcgtgatttttcttttcgcaagcnggtgacataagcacccacccgcgaaaaacg

SEQ ID NO: 55640 - DNA, 101 bp, rice(Oryza sativa)
  misc_feature (71): n=a or g
aagcgcgtcgggtcgcacgcgcgcgcctccccgcctcttatcttctcgatatctacacgcctagtcatctncgtctcctcctctccctcgagacgtgtctc

SEQ ID NO: 55641 - DNA, 101 bp, rice(Oryza sativa)
  misc_feature (71): n=a or g
caaaaactataggtgccgtagctcgtggctctacgacaatagacaccgtaagtcttattcaaaaacttttntgagatatataaaactatatgtatacctaa

SEQ ID NO: 55642 - DNA, 101 bp, rice(Oryza sativa)
  misc_feature (71): n=a or g
gagcgagagagcgtgagcaagatttgggagagggaagggagggggagtggacgagcagtggtaggagaggncccttcatcgtgccgctgccgttgcaccta

SEQ ID NO: 55643 - DNA, 101 bp, rice(Oryza sativa)
  misc_feature (71): n=t or c
cccggcatgctcccgcgccgcctcctccttctccccgtgtgttcgccgtcggcctccccatctcccttganggcctcccagcctccttcctcttcgtgcat

SEQ ID NO: 55644 - DNA, 101 bp, rice(Oryza sativa)
  misc_feature (71): n=a or g
tggatctatatacaattcttattttctactacctctattccataatgtaaggtatggtcaaactcggcacngtatacaaaactattttttgacttataatt

SEQ ID NO: 55645 - DNA, 101 bp, rice(Oryza sativa)
  misc_feature (71): n=a or g
caccgtcaaactgaccatccaaatcaggggtaacatgttgctgtattttcaaaagaactagggtaaaatcncaaaccctaaaaaataggggtaaaatcata

SEQ ID NO: 55646 - DNA, 101 bp, rice(Oryza sativa)
  misc_feature (71): n=t or g
tcttcctccgcgcgcggttggtgcatcgagtgcgtactaactcgaagccgattgaagctggcggactggcncgatggcgtgcaggctcgcttcatgtgtct

SEQ ID NO: 55647 - DNA, 101 bp, rice(Oryza sativa)
  misc_feature (71): n=a or c
tatattgatttcacttcatcccccatccccgaatcatgaaatcccaaatcgattatctcctccaaatcctnaaatcgatcatctctaaatacatcacaaaa

SEQ ID NO: 55648 - DNA, 101 bp, rice(Oryza sativa)
  misc_feature (71): n=t or c
tacttgtcattttcttcccttctactcccaaaataagaagaaaagactatccctatggccctattgactcngcttatggacctgcttttactactttattt

SEQ ID NO: 55649 - DNA, 101 bp, rice(Oryza sativa)
  misc_feature (71): n=t or c
ttattaccatgtaataaggtaatatttaatgcttactacctgctattttgctacattgtggatgcccttangacgcagacttgcagctatgggcaacgtta

SEQ ID NO: 55650 - DNA, 101 bp, rice(Oryza sativa)
  misc_feature (71): n=a or g
gcacagcttaagatctctgtttccacattccacattgctgatgcactcgacgaagaaaccttcatttggtnaaacccaatttttggaggaaacgctccgcc

SEQ ID NO: 55651 - DNA, 101 bp, rice(Oryza sativa)
  misc_feature (71): n=t or c
ttacttagatacggaaagatgcaggtaaagtaaattaggatcacatttgccgtatctgtactactgtacgngaaattgttgctgatgatgttttaatagca

SEQ ID NO: 55652 - DNA, 101 bp, rice(Oryza sativa)
  misc_feature (71): n=t or c
gaccgagcaggatatcggagatcgccgtgactgagctgctctaactccacttttctaggatccagccaaanagtttcagtttatctaaaatagttgtgaag

SEQ ID NO: 55653 - DNA, 101 bp, rice(Oryza sativa)
  misc_feature (71): n=a or c
gcctccgttgagatctccgacaccgacaccgtgtgactgaccacagattctgcaagccacacagactctcnggctgtgtttacttcacgctaaaattgaaa

SEQ ID NO: 55654 - DNA, 101 bp, rice(Oryza sativa)
  misc_feature (71): n=a or g
aaggggtgtggtgcgctagtgcgtgaaccagactgcgccggtggcaggagaggaggccgacaaggatgtcngtggtgggcacattgatagggtagcaggcg

SEQ ID NO: 55655 - DNA, 101 bp, rice(Oryza sativa)
  misc_feature (71): n=t or c
acgctggcgcaggccaggaagagatgaagaggtgatgtaaaactgattacttttacattttataccttttnaaaaacttattttacaaatacactcttaaa

SEQ ID NO: 55656 - DNA, 101 bp, rice(Oryza sativa)
  misc_feature (71): n=a or g
taagctgccaatttcattgaatagaggaggagtaaactttataagtgtgaagcaaaaaacaaagctcaggnccttcggttcgagcaattaaaaagaaagtc

SEQ ID NO: 55657 - DNA, 101 bp, rice(Oryza sativa)
  misc_feature (71): n=a or g
tgctgattaggatgccacgttagctaaacgaaagatctatactgccatgggactgaaattgtacagttttntatagtttagggatagagatttctggtact

SEQ ID NO: 55658 - DNA, 101 bp, rice(Oryza sativa)
  misc_feature (71): n=t or c
ccgaccaaataccaacttagttaggagatgggtagatggcgttgacatgaaatgtttttgtagcatgaaangagtgctggtgacgatgagctagctcatca

SEQ ID NO: 55659 - DNA, 101 bp, rice(Oryza sativa)
  misc_feature (71): n=a or g
tttagcatcaaacatggttcaaatggtgtgggtttttcatggtgtgatgttggcatgttgtgccacattgntttgggcaatggttgcccatagttgatgat

SEQ ID NO: 55660 - DNA, 101 bp, rice(Oryza sativa)
  misc_feature (71): n=t or c
agtaatagtaacataattatatgtactagtagtgttttttcactcgttataaatatatctgatgcagtagncttttgataggattaatatatactccctcc

SEQ ID NO: 55661 - DNA, 101 bp, rice(Oryza sativa)
  misc_feature (71): n=a or g
gaaaagaaactatgagagagagcaaaagagaagtacgacgtgttgaacaaacgatttttaacaccagtcgnaaatcacctctagcatctgttatagcaacc

SEQ ID NO: 55662 - DNA, 101 bp, rice(Oryza sativa)
  misc_feature (71): n=t or c
tttgttcgtaaatggcatttgcgcccgtgtgactttcattcgatccactgcctttctgcctacatttggtntttgtgttgtccaatagtagaatgaactaa

SEQ ID NO: 55663 - DNA, 101 bp, rice(Oryza sativa)
  misc_feature (71): n=a or c
atttttcattcttatcatttttttccttgtacctactacctagttgttctttctcagccttatttctgtanaaattaactgttacatagcatctgcattga

SEQ ID NO: 55664 - DNA, 101 bp, rice(Oryza sativa)
  misc_feature (71): n=t or g
tcccaaattaagttcatttctcactcattctacacatactatcaccaaaccaaaacaaaaaaaaagactanaatacctcaactttatcaaatcataatgca

SEQ ID NO: 55665 - DNA, 101 bp, rice(Oryza sativa)
  misc_feature (71): n=t or c
cacgattttgcttttgttgcaattctgtaaattttacaagttcttttctactgcatttaagtcgcacatanacatatgtgcacaacatgagcaggcactat

SEQ ID NO: 55666 - DNA, 101 bp, rice(Oryza sativa)
  misc_feature (71): n=t or c
ctccttgattcatggtcatggcctaacttcctctggtttttcgttcaacctgcttccgttcttttccgatngttaatactccctccatcctaaaatgtttg

SEQ ID NO: 55667 - DNA, 101 bp, rice(Oryza sativa)
  misc_feature (71): n=a or g
acaaaattttcttgaccgggttcctgggcacccccctcaaacactctagctccgtccctggctccagagcnacttagtactagggttgaaactggttcgga

SEQ ID NO: 55668 - DNA, 101 bp, rice(Oryza sativa)
  misc_feature (71): n=a or g
agtttatttagtgataaatctactgcgttcggcccaaggagattgtgagaaagtttgtttgtttttctgcncgcacgcttcccgaactactaaacggtgta

SEQ ID NO: 55669 - DNA, 101 bp, rice(Oryza sativa)
  misc_feature (71): n=a or g
aaaaagatactataggtcaaacgtattacaaggaagcgataatctacgatatgtctttgttaacttatatntaaatatgtaacaacttgcatgaatataaa

SEQ ID NO: 55670 - DNA, 101 bp, rice(Oryza sativa)
  misc_feature (71): n=a or g
atgcattatactgtcaaagagctccacatactctgctacacggcagtctgtttcgcatgtatccactgccnaattaaagtttgttgtctgtcccttgtgaa

SEQ ID NO: 55671 - DNA, 101 bp, rice(Oryza sativa)
  misc_feature (71): n=t or g
gtaccagccgcccaagggctaaaattgtatttttgcattcgcctttcgtcccgcaagccacaggagtccgncggccgacgcctctgcccgttcatcttccc

SEQ ID NO: 55672 - DNA, 101 bp, rice(Oryza sativa)
  misc_feature (71): n=a or g
ccttcactcttcccccactgctcatcggtgatgatcacaccttcagcgcaactggatccctcttcaccgcncgtcgatggcttttttcttttctccctttc

SEQ ID NO: 55673 - DNA, 101 bp, rice(Oryza sativa)
  misc_feature (71): n=a or g
aatcaacactgacacgtcagacacagctggtgtgacagttttgtcctgtcatgccaacgagggtggcgtgnccaaataacactgtcacgccaattagaccg

SEQ ID NO: 55674 - DNA, 101 bp, rice(Oryza sativa)
  misc_feature (71): n=t or c
tagagattgaagcgctctgttacgaagctgataagtcaatccaaacggccacacggtgcgggcccacgttncggctgcatgcacagctcgccctctatcag

SEQ ID NO: 55675 - DNA, 101 bp, rice(Oryza sativa)
  misc_feature (71): n=t or c
agatccctctcgcgcgctctctctctctctcaccagggacgctattggcatcgcggtgacgcggtggcgcnaggatcgagatcgggatcgacctccgcgct

SEQ ID NO: 55676 - DNA, 101 bp, rice(Oryza sativa)
  misc_feature (71): n=a or g
tgaataccggcggtggtacaccattcgtgtccacggtggagctgaggccgtttgaaagcttggcctacccnaccgacaatcagtcactctccctctatgaa

SEQ ID NO: 55677 - DNA, 101 bp, rice(Oryza sativa)
  misc_feature (71): n=t or g
tccgaccggaatttgagatggcgtgtcgccggcggcgatcgatcggcgtgatggtggtgcatgcgacaatngcataaaataaaggaagaagcctcttctct

SEQ ID NO: 55678 - DNA, 101 bp, rice(Oryza sativa)
  misc_feature (71): n=t or c
gccacaccttacaaaattagtgggctattaacaaataaaaaaatagctacttccttaattattagtcgccnggttttatatatatatatatatatatatag

SEQ ID NO: 55679 - DNA, 101 bp, rice(Oryza sativa)
  misc_feature (71): n=t or c
ttagtgggcccacattttctttgtgtgtgtgtggatgacaaatggacccacattatgtttttaactctaangccacctaagcgccacatcaacgccacaga

SEQ ID NO: 55680 - DNA, 101 bp, rice(Oryza sativa)
  misc_feature (71): n=t or c
ttatgtttctttgcatactctaagttgcatcgactttagtcgtgcttaagagtcataatctctagtctgtnttttattacaataagggtttcatcggggtt

SEQ ID NO: 55681 - DNA, 101 bp, rice(Oryza sativa)
  misc_feature (71): n=t or c
ggttggtcctggttttggaggtaggtaaattttgggaccatacttagaagtctgttggagggctgattttnaccaaattcctaaaatttatgttttagtaa

SEQ ID NO: 55682 - DNA, 101 bp, rice(Oryza sativa)
  misc_feature (71): n=c or g
tatgcaagaggtgaggaagaagccccatcttacataacagtgacagcgtgaagaacaagtccccgcaaganatgatctcatcttctatgaaggggaaagaa

SEQ ID NO: 55683 - DNA, 101 bp, rice(Oryza sativa)
  misc_feature (71): n=a or g
agcatccctgaaaaactggaatgtaatttatttagattgatgaggtcactacaagtgacttgctgtggacnggaacgtcgtctaccactgaaaaacaaata

SEQ ID NO: 55684 - DNA, 101 bp, rice(Oryza sativa)
  misc_feature (71): n=c or g
ccatggcgaggacgacggccgcagatgctattgggaggaagatctcaaggaacttggaccgagccttgggnccctcccgtggcagcttgggcagcttggcg

SEQ ID NO: 55685 - DNA, 101 bp, rice(Oryza sativa)
  misc_feature (71): n=t or c
tcttccatgacaagatgagctacctgataaactgtacaggaacgattattgaaaattctcctatttctttntaaccaaatatttcaccaagtagttaacag

SEQ ID NO: 55686 - DNA, 101 bp, rice(Oryza sativa)
  misc_feature (71): n=a or c
tcgctgaaagagtacatgggatcattcaccgtgccgctgatcgaagaaacttgtggatattatgggtaccncatacccatacggcatggttatccgactag

SEQ ID NO: 55687 - DNA, 101 bp, rice(Oryza sativa)
  misc_feature (71): n=t or c
aaaccatctttgtctggtcggccaaaattcacaatagttccggttcattaaaaaaaccgggactaaaaatnatatttagccccggttgaaaagcccatagc

SEQ ID NO: 55688 - DNA, 101 bp, rice(Oryza sativa)
  misc_feature (71): n=a or g
cctacggtaataaccacattgtcgccggaagccatcatcacttccccttgccgccgtcgcagctgatgccncagctcggcacgctgccgatctcgccgccg

SEQ ID NO: 55689 - DNA, 101 bp, rice(Oryza sativa)
  misc_feature (71): n=a or g
ttaggcctacatgtcagtgagcagtactgcatctgcagtactgtaggtgatctcaattgttcaatttgtantcagtccatggtattttctattttagtcct

SEQ ID NO: 55690 - DNA, 101 bp, rice(Oryza sativa)
  misc_feature (71): n=t or c
aggtgaggactagctagagtttttttttttaaaaaaaaatgttcccgcgctttttgtggagttgttttacntgcttgcaaggagcagcagtgcatggagtt

SEQ ID NO: 55691 - DNA, 101 bp, rice(Oryza sativa)
  misc_feature (71): n=t or g
tcctgcattttttgtaacctgaaaagaaaagttagataagttcgctggatatgaaaaagtgacataaattntgatagttaatctacatgttgcctaagttt

SEQ ID NO: 55692 - DNA, 101 bp, rice(Oryza sativa)
  misc_feature (71): n=a or t
gaaatgatcacagaaaaatccatttcttctgtcagtttcccaatggaaatacaattcctcgatcaatctcngccaggtcactcacaagaaaaatctagcaa

SEQ ID NO: 55693 - DNA, 101 bp, rice(Oryza sativa)
  misc_feature (71): n=a or t
ggaattgaagggatgagggggaccaagtgggagggatcagggagggagggaaggacgatatggtttagggngttaactagggttttctttaaactggttga

SEQ ID NO: 55694 - DNA, 101 bp, rice(Oryza sativa)
  misc_feature (71): n=a or t
ggcacgcacgaacgcttgcagttgccattacaaattaaacacctatccgtttgtgcaaacagctacacgtncgtaccattttgacgtgatgatatatgcag

SEQ ID NO: 55695 - DNA, 101 bp, rice(Oryza sativa)
  misc_feature (71): n=a or t
ttgtgaacttcatcaaaatactagaaaatcagcctaaaacactgaggattggataggggaggaccaggatnggagccaggccaaaggccaggctagggggg

SEQ ID NO: 55696 - DNA, 101 bp, rice(Oryza sativa)
  misc_feature (71): n=c or g
gccacgtcaggcgtgggcccccaccccaccccaccgtaaaaccaatggcaccgagaaaacgaccccacccngccggcgcgcggggaccacctggcagccac

SEQ ID NO: 55697 - DNA, 101 bp, rice(Oryza sativa)
  misc_feature (71): n=a or t
tgattcagctactagttttttcatattagtcaccaaccgtggcccatgggttgcacgattattattattantattgtaaatatttgtataatcatatataa

SEQ ID NO: 55698 - DNA, 101 bp, rice(Oryza sativa)
  misc_feature (71): n=a or t
gtcgtgaagcatctccaaacatatactccccttaagagtcgtagggatcacaatctctatgccctgatcangcgcacgaagctgcatagtgctattgcagt

SEQ ID NO: 55699 - DNA, 101 bp, rice(Oryza sativa)
  misc_feature (71): n=c or g
aaatgttgaacacaaccaatgcaaaactgcagtcttctgggatggaagtagtataaaactatggcgtgcgngtggcaaactgatgtgattagccacttgtc

SEQ ID NO: 55700 - DNA, 101 bp, rice(Oryza sativa)
  misc_feature (71): n=a or t
ttgagcacgccgtgtatgctcgaggtgagggaacacaccgcttgcttgttggtgtttatgtggatgatctnatcattacaggaagtgatgctgtggagatt

SEQ ID NO: 55701 - DNA, 101 bp, rice(Oryza sativa)
  misc_feature (71): n=c or g
tcctgcagcataggaagcataatatggtggttctggaaggtaacatccggactgttaaaatacgaaatggnaccttccgaggtggagtaacgatgatgatc

SEQ ID NO: 55702 - DNA, 101 bp, rice(Oryza sativa)
  misc_feature (71): n=c or g
tgcatgtcctatatgctatactactccatctcttgattataaaataacctgggtttgtcccccaaacgtantcgatcctaataaattaggacaatgtcatt

SEQ ID NO: 55703 - DNA, 101 bp, rice(Oryza sativa)
  misc_feature (71): n=a or t
tgggtgatctggttaaaaaaatttctgatagcacgtatcaacagtcactcaagcggttcgtagtagtgatntatgtagtattactacatatgtagtagtga

SEQ ID NO: 55704 - DNA, 101 bp, rice(Oryza sativa)
  misc_feature (71): n=a or t
aaatatccactgtgcctaattaagatcttcaatgactcctccaagtacctagttccagtcaaggaagtttnggatgataatgattatgaccagaacattac

SEQ ID NO: 55705 - DNA, 101 bp, rice(Oryza sativa)
  misc_feature (71): n=c or g
ccaccacaactgggaagaattaactcataatctaacacagagataaaacaacacaactcataatctaacanagataaaacaacacattgtaacactcaata

SEQ ID NO: 55706 - DNA, 101 bp, rice(Oryza sativa)
  misc_feature (71): n=c or g
cctcggtacagctcttcctccaagctgaaattcttggggttcgtggtgacatcggggcctcctcctcctcntcttcctcctcctgctgcctgctgctgcgg

SEQ ID NO: 55707 - DNA, 101 bp, rice(Oryza sativa)
  misc_feature (71): n=a or t
atgctttcatcagaattacgggagtccccttgataaagttggctaattcatgtattgtgcaacaagaaacnaccttgtatgtgcatattatatccactata

SEQ ID NO: 55708 - DNA, 101 bp, rice(Oryza sativa)
  misc_feature (71): n=a or t
tggttccagtgtcctcttcttgagcgtcgtctagcttgtgatgccgagaattcattgtgtcatctatttcntcataagtattattcaaagcagatgatgca

SEQ ID NO: 55709 - DNA, 101 bp, rice(Oryza sativa)
  misc_feature (71): n=c or g
tgctgcactgcagcatcttcctcttgatcgccatgatcgcctccccaccacctcgcctgctcctcctcctnctgctgctgctgctgccacccgtgtcttct

SEQ ID NO: 55710 - DNA, 101 bp, rice(Oryza sativa)
  misc_feature (71): n=a or t
acttccaatatacacgacaactgtgcatcaacaattcagctcgtattgctactatgtagttgttgttgtcnactccttatttccatttttaaatatttgtt

SEQ ID NO: 55711 - DNA, 101 bp, rice(Oryza sativa)
  misc_feature (71): n=c or g
ctgtcggtgaactagtcgtcgtggcatccaaacagttgtgcttactgaaactgttcaactgcatgttcccntgtgtttctttatttgtgtatactgtgtgc

SEQ ID NO: 55712 - DNA, 101 bp, rice(Oryza sativa)
  misc_feature (71): n=a or t
gaatattttttttaatggttggaaccagtatcgtgtgaaagtactttgtgataagaatgtattgaaataantttttatgtattggatgtcattgtagtttt

SEQ ID NO: 55713 - DNA, 101 bp, rice(Oryza sativa)
  misc_feature (71): n=a or t
ttatctatactccttttaaaagagaacaatgctggtgataatgaacctaccaacagctcaccaagtttttntttatttatttatcacctactctatcatgt

SEQ ID NO: 55714 - DNA, 101 bp, rice(Oryza sativa)
  misc_feature (71): n=a or t
aacggtcacggaaattttcgatagatagaacatcgcttttgcgaaagtagcatgggctgtaaatttttttnaaaaaaaaacttttatgccgtactgtaatt

SEQ ID NO: 55715 - DNA, 101 bp, rice(Oryza sativa)
  misc_feature (71): n=a or t
tccgacgatgtgtgcattgtttccggcaatagtagcgatttgaccagtcttttttttaaagtctggaaatncgtggtatctcgaaagatagtattggtggt

SEQ ID NO: 55716 - DNA, 101 bp, rice(Oryza sativa)
  misc_feature (71): n=a or t
agtaatcttggaaatcgccgctggtgaattgggatccgttgtccgtaaggatgcgatgaggcaacccatanctgcagaatatccctctgatgaatttgatg

SEQ ID NO: 55717 - DNA, 101 bp, rice(Oryza sativa)
  misc_feature (71): n=a or t
aaatatcgaatgcgggtggaaaataaatttttcacgcaactgatgactagatggagaacctcttttttttnaaaaaaaaagttacagtttttgacaaaatg

SEQ ID NO: 55718 - DNA, 101 bp, rice(Oryza sativa)
  misc_feature (71): n=a or t
caccttgtactgtggccaaattgcactacacccagtaggggcattggcacatttgatgcaatgtatgcagntgtggtatgttccatgttgttcaaacccac

SEQ ID NO: 55719 - DNA, 101 bp, rice(Oryza sativa)
  misc_feature (71): n=a or t
agtctactctcgaggtctgctcttccattccgagaacacaaaaaccaagttactccgggaagaaaaatganggagatgaaaacaaagatcaccaacttaag

SEQ ID NO: 55720 - DNA, 101 bp, rice(Oryza sativa)
  misc_feature (71): n=c or g
ggggaccaccaccaccggcgtctgcgtcacctactggctcaaccttctccaggtaaaacccacgtcaaatntcgacaaaattcaaccgtaatttcaacgtt

SEQ ID NO: 55721 - DNA, 101 bp, rice(Oryza sativa)
  misc_feature (71): n=a or t
tggcaagggccacgccagcggcaaaagccgatttcaccagcgattcccggcaggtttgtatataagagatngggtagacatgagctacttgttggttgata

SEQ ID NO: 55722 - DNA, 101 bp, rice(Oryza sativa)
  misc_feature (71): n=c or g
tccagatgtactcctccttcaagcagaaaggaggatgatctcgtccagaccgaccgccatggaattaatcnatcgatactcccaccgtcccataaaaaacc

SEQ ID NO: 55723 - DNA, 101 bp, rice(Oryza sativa)
  misc_feature (71): n=c or g
ctcacattccgttcgtgatgacaagcccatcacggcaccgtcgcaccaactccgccaagctccggtagctnctccctccggcggccaccgccctcgccgcg

SEQ ID NO: 55724 - DNA, 101 bp, rice(Oryza sativa)
  misc_feature (71): n=a or t
taacctagtgctagttatatctcaccacaaagcagatgtggagattctttttagcaacaattatttttttnaaaaaaagttgatactatgcaaaaacaaaa

SEQ ID NO: 55725 - DNA, 101 bp, rice(Oryza sativa)
  misc_feature (71): n=a or t
aaaacttgagaggagaggctagcgggcctaccttagtccataactacaaacgcaatgggggcctggtggcngcgtcgctggttcaaatcgagcccaactct

SEQ ID NO: 55726 - DNA, 101 bp, rice(Oryza sativa)
  misc_feature (71): n=a or t
attatatattatacatttatacaactaaggctatgcatgtgcatgttatggtgagtgaaaagtaagaaaantttgtaagattaaaacattgaataagccca

SEQ ID NO: 55727 - DNA, 101 bp, rice(Oryza sativa)
  misc_feature (71): n=c or g
actcatcaatagctaggttgagatcgagaagcctaggccgtcgtcgtcttgatgtcctcctcttcctctcnctacgcccgtcaccgtgacagggcgcactg

SEQ ID NO: 55728 - DNA, 101 bp, rice(Oryza sativa)
  misc_feature (71): n=a or t
agaagaaaaggtaacggaggagggaggatgaagtaaaggagaggggacttaagtatcggaaattttttttnaaaaaaaaatcaatatagctatttaaaaca

SEQ ID NO: 55729 - DNA, 101 bp, rice(Oryza sativa)
  misc_feature (71): n=c or g
atagtgtgctgcgaacgttcactctcacaaccagtcaaccacaaccatccgttcgattgatcgatccttcnaaaccctagcttagtcgttgactcctgcgc

SEQ ID NO: 55730 - DNA, 101 bp, rice(Oryza sativa)
  misc_feature (71): n=c or g
atgttaatcgtctagataatccgtgttcttttgttttcaattatgcaggcaaacccagaaatatgtctgtntattagcacgtgcttaaagtgactgaccag

SEQ ID NO: 55731 - DNA, 101 bp, rice(Oryza sativa)
  misc_feature (71): n=a or t
ttggtacatctaaagtttcagagcagagtgtagcatttaccccagcttggtagttcaaaggaccatgtagntcaaaggaccatcagatcaaaaggtaagta

SEQ ID NO: 55732 - DNA, 101 bp, rice(Oryza sativa)
  misc_feature (71): n=c or g
taataaggagacttatatgagggcctctaattaattagcataccaaagacatattttttgcgcaaactccnatattgaatttacacatgttgttttacagt

SEQ ID NO: 55733 - DNA, 101 bp, rice(Oryza sativa)
  misc_feature (71): n=a or t
ataagccacatagtaaagtgagagtagggaacatcatttgctaaaagactaatggaagatcacaaccatgngttaaaaaatcaaaaaataatgaactattc

SEQ ID NO: 55734 - DNA, 101 bp, rice(Oryza sativa)
  misc_feature (71): n=c or g
tataaattctaaacaagtaaaaaaccaaaagctacaatgatgtttgtgaaaaaagctagaggggttaaagngattccacagcctctcgtacatagctccgc

SEQ ID NO: 55735 - DNA, 101 bp, rice(Oryza sativa)
  misc_feature (71): n=t or c
ggtaggtggtaccttgtcggcgccatcatttccaaaattccacctttgtaccttattggagtcttcaccanggttcatcaatccctagtactcacgtatta

SEQ ID NO: 55736 - DNA, 101 bp, rice(Oryza sativa)
  misc_feature (71): n=t or c
ctcgactccacatgttgctggccacgtccaaacagtaggttcctgcgtcctcagccgatacgaggatgcgncacgaaccgtcgtcatcgccggcaaccacg

SEQ ID NO: 55737 - DNA, 101 bp, rice(Oryza sativa)
  misc_feature (71): n=a or g
atttgtaagtccaattttcatgaatatttacttattttatgggatgttttttagtgtgacaagtgcaacangtttgttttttatgggatggagggagtgtg

SEQ ID NO: 55738 - DNA, 101 bp, rice(Oryza sativa)
  misc_feature (71): n=a or c
acgatgtctccataagggttgtcctagacgaggaacaaacctcactggtacatcggcgaagagaccaactntatggtgaacgcaccactgtggtagaacac

SEQ ID NO: 55739 - DNA, 101 bp, rice(Oryza sativa)
  misc_feature (71): n=t or g
tcggaatcggagttggagccagatttggaggggcgcacgatgggggccatggtttggtttcctctgctccngtggtggaagaagaagaggagaggaagcgg

SEQ ID NO: 55740 - DNA, 101 bp, rice(Oryza sativa)
  misc_feature (71): n=a or g
gaaagcagtgaagcttttattcagatcttgcatgctcatatataatggctgctccatttcgcaattttcanctcaggtgtgtcagaatggtaaaaataaaa

SEQ ID NO: 55741 - DNA, 101 bp, rice(Oryza sativa)
  misc_feature (71): n=t or g
agccctttccgcgctgccgctctctcccttcccacccgcgagctgcagtagtagcgccctccccactcgtnagattcggcggtgtcctccccatccgcgag

SEQ ID NO: 55742 - DNA, 101 bp, rice(Oryza sativa)
  misc_feature (71): n=a or g
ggtaagcggcatccgtgcgcgatctgagccgttgattccaccgaacgcccccggctgctacgacacctccntgtggggcccacgtgacagcgacccactcg

SEQ ID NO: 55743 - DNA, 101 bp, rice(Oryza sativa)
  misc_feature (71): n=t or c
gagaacgcggtacatcagcacgcgcctctccctcactactctgacggtgaccaactatgtcggcaagatgnaggcattggtggacgagctcacggtctctg

SEQ ID NO: 55744 - DNA, 101 bp, rice(Oryza sativa)
  misc_feature (71): n=a or c
tgtaggtttatgctcttggagcgtttattgtgttgagatgggcctgggttaagtggaaagaaagcaagganagagatgattcgcctgatggccgatccccg

SEQ ID NO: 55745 - DNA, 101 bp, rice(Oryza sativa)
  misc_feature (71): n=t or g
attaacgaaatcccgattgctgatcccatttatgatataagtccatcaagaagcgagaagcctgcatctantggttcaactattgatgcagttttgttgca

SEQ ID NO: 55746 - DNA, 101 bp, rice(Oryza sativa)
  misc_feature (71): n=a or g
gaaaggttggtctatcatcaattggtccagtgattctgaagatctgtccatcaaacttgttgccactgccncatcttctcttcccccgatcctcaatgctt

SEQ ID NO: 55747 - DNA, 101 bp, rice(Oryza sativa)
  misc_feature (71): n=t or c
ggcaatcatgaagggggttagtgaagtttttccacgtgctgaacatagagaatgtatgtaccacctagttnagaattttaagaagaggtacagtgggaagg

SEQ ID NO: 55748 - DNA, 101 bp, rice(Oryza sativa)
  misc_feature (71): n=t or c
cattttgagatgatcaaaggaagatcatgtacctggtaggtataacacaggaaacagtctccatatcctancagctgcagctccaattgaacattcagatg

SEQ ID NO: 55749 - DNA, 101 bp, rice(Oryza sativa)
  misc_feature (71): n=t or g
ctgagcaagaattttggtggcaagtttgctgcacatggaagaggcgatctgctcaagcctggcgtagtctncactgttcttcaggctctgctcggctgaac

SEQ ID NO: 55750 - DNA, 101 bp, rice(Oryza sativa)
  misc_feature (71): n=t or c
tgatcaacttgttactctagcccaacaagaactacacccaccatagttccctcgcctcgcatgtcagtttngtcgaggtggtaggagagtaggtggatgcg

SEQ ID NO: 55751 - DNA, 101 bp, rice(Oryza sativa)
  misc_feature (71): n=a or g
accaattgcaacaaaaactagaggaaaaagaagaagagggaggagattactccgtagttgggggattgganaggagcacacttgaggcagtcgcatggcac

SEQ ID NO: 55752 - DNA, 101 bp, rice(Oryza sativa)
  misc_feature (71): n=a or g
cattcacccagcattagccggtttcacaacagcatcataaagcagctgctcggccatggcaccaccgcctncggtgctcagctccggtgagctcggcgcgc

SEQ ID NO: 55753 - DNA, 101 bp, rice(Oryza sativa)
  misc_feature (71): n=t or c
gcagaagtacctgatttgcgaactcgggtgtcgaggacagcaacaggaactttcttagtttccatttgagnaggaatcataggagaagaaacacctttgaa

SEQ ID NO: 55754 - DNA, 101 bp, rice(Oryza sativa)
  misc_feature (71): n=t or c
cttggctccggctgccccattatgcttgcgaagtggtcatgaattgttgcctccttctcctcatgcgtcancgcccaaccattgtccttcctcagccgttg

SEQ ID NO: 55755 - DNA, 101 bp, rice(Oryza sativa)
  misc_feature (71): n=t or c
acttgtgaaagcagcaggctgcctgcctcgattttttttttatatgtacacctctcccacactccttgctntctcgtttgctcttctactgctcatcctcc

SEQ ID NO: 55756 - DNA, 101 bp, rice(Oryza sativa)
  misc_feature (71): n=a or g
caacatgattgagttgtgtctcctcgtggctattagatgaaacttggtctgcgcctctggtcatatattcnggaagaagcttctcatggaagggtaatatg

SEQ ID NO: 55757 - DNA, 101 bp, rice(Oryza sativa)
  misc_feature (71): n=a or c
agggggaggaggaggaggtggtggtggtggaggcgcgcgggaagggttagggtttgggggttttgaggggnagaggaggcagcagaagaggcgggagaagg

SEQ ID NO: 55758 - DNA, 101 bp, rice(Oryza sativa)
  misc_feature (71): n=a or c
acaatgcgacgcagtagaaaatagtggcaccgacggaagaacccatgcctgtcaaatttaattacgagagnaaatttaatgggaggaagaagggaacgctt

SEQ ID NO: 55759 - DNA, 101 bp, rice(Oryza sativa)
  misc_feature (71): n=t or c
ccatctccaccagcagaaggatcccatggaggaagaccctgccattcagtactgccctcaaacttctcttngcatttggcattggttgcaagtttttgttt

SEQ ID NO: 55760 - DNA, 101 bp, rice(Oryza sativa)
  misc_feature (71): n=t or g
actttattatgcggaattcaaaagtgcttaaaaagatcactgttgttttctcaagttggctttgttcatanagacgctttctacgcaatctccgcaaacta

SEQ ID NO: 55761 - DNA, 101 bp, rice(Oryza sativa)
  misc_feature (71): n=a or g
gaggtgcaaccgccgtggtacctgcggaagaggaggcaaagattggggatacactgagccgataggaggcnaggtcaccgctggcgctgaagatggaaggg

SEQ ID NO: 55762 - DNA, 101 bp, rice(Oryza sativa)
  misc_feature (71): n=t or c
ttgctttcaacattgatgcaacctgtgaacactagcacaaaaggctcacagaggtcagcgttataggtgcngaaagtgttaaaagtggcacctatataact

SEQ ID NO: 55763 - DNA, 101 bp, rice(Oryza sativa)
  misc_feature (71): n=t or g
taaggcccgcggctgagggatttcacttcaggtgataaacatagccacccctagcatcatacatgaatacntaccttctgttgcacttgtgaaatattgtt

SEQ ID NO: 55764 - DNA, 101 bp, rice(Oryza sativa)
  misc_feature (71): n=a or g
gttgcacccaaaatgcctttcccctgatatggagtcttgttgaaagtcctgtagctctctttaaatgtctncttcactggtgccttcttgttcatttcccc

SEQ ID NO: 55765 - DNA, 101 bp, rice(Oryza sativa)
  misc_feature (71): n=t or c
gaagcaagaccaccatttgtagtctttggaaatcaacatgaggaatattgaccaaccagattttaggtagnggatgatgtctccagaaacaatattccatg

SEQ ID NO: 55766 - DNA, 101 bp, rice(Oryza sativa)
  misc_feature (71): n=a or g
atcggcagcgtgccgtggtggcagatgtgcaatgcggtgaagacgggagaaaccattggaatgaggatgtnggatgtgggctgggcttcacatgtgcgtgc

SEQ ID NO: 55767 - DNA, 101 bp, rice(Oryza sativa)
  misc_feature (71): n=a or g
taaccaatcagaaagatgctcaacaccagtaaaagggttattcgaatggaacgaccaaactgagtgttgtnttgcggcccttgtatatgaagtccacccat

SEQ ID NO: 55768 - DNA, 101 bp, rice(Oryza sativa)
  misc_feature (71): n=t or c
agtttgggttctagggtcgatttttatacatattctttcttaaagaaacacatcaagggaggccccggccngctattgatttcaatttattaataaaagaa

SEQ ID NO: 55769 - DNA, 101 bp, rice(Oryza sativa)
  misc_feature (71): n=t or c
agcgcaaggattttggatatgatcttgccgaccccgtgtagaaggcttattggacggtaatcggccactgnctccgcatccactttcttcgggagaagaac

SEQ ID NO: 55770 - DNA, 101 bp, rice(Oryza sativa)
  misc_feature (71): n=t or c
atctatcgtcgactctcactactcgcgggtttatcttatctctcggagcggcgcgcgggttagctacagcnagaggatcacacagtaataattaataatta

SEQ ID NO: 55771 - DNA, 101 bp, rice(Oryza sativa)
  misc_feature (71): n=a or c
acaacaaaggccgccgggtcacacacaccatgcgtaggttggacgtcatctgcaccctgttccgtctctantttgacatgttgccctcgacagcgcccagg

SEQ ID NO: 55772 - DNA, 101 bp, rice(Oryza sativa)
  misc_feature (71): n=a or g
aatgagtaacgtcctacgatcactcaagatcaccaccttgaaaaggacttatgggccatacggcaaccctnaagctgggatcccttttagcttctcagttg

SEQ ID NO: 55773 - DNA, 101 bp, rice(Oryza sativa)
  misc_feature (71): n=t or c
tagagttttatgggtgagatttgaggaggaaggaagtggggatcaagcttaagagggattacctaggaggnagcagaccgacggtgggtgacgaacaaggg

SEQ ID NO: 55774 - DNA, 101 bp, rice(Oryza sativa)
  misc_feature (71): n=a or g
gacagaaaaaaggcaaaaccaacgaaccagttttttttctcgtttcgatctcccgtcctccacacacgcangttaggcatacaagtgggtccttccccgat

SEQ ID NO: 55775 - DNA, 101 bp, rice(Oryza sativa)
  misc_feature (71): n=t or c
acctgcactggacctgcactcgtcgtaactggtagagaggaggcccaacaacgagtttttgacagggatgnagaggcggagataggggcaatggtggctga

SEQ ID NO: 55776 - DNA, 101 bp, rice(Oryza sativa)
  misc_feature (71): n=a or g
gaggccagtcttctggctgaaatacccaaagagaacatgccggatgatctccgcaagcccctcgctgcgcncccttagcgtctcagggtccgcgcacagct

SEQ ID NO: 55777 - DNA, 101 bp, rice(Oryza sativa)
  misc_feature (71): n=t or c
ttccagcatgtaagctagagcaataatcttgatatcaacatctgaaagcgtctggaggtctcctgtttccngggcaaatttgacaactgccagaaacaaag

SEQ ID NO: 55778 - DNA, 101 bp, rice(Oryza sativa)
  misc_feature (71): n=a or c
aacgagcgcgacaggcgccatgaacaaaatgcctagcgatgatcgatcacatcaatactgaccgtcctggngtgattttttaccaggaggccgaaggcgag

SEQ ID NO: 55779 - DNA, 101 bp, rice(Oryza sativa)
  misc_feature (71): n=a or c
gtttgtctagcccgttgcaaagcgaggcctagatgtttcgggattggggttatgccgatgtccacccggancacccaggcctcttgtgcatactcctggaa

SEQ ID NO: 55780 - DNA, 101 bp, rice(Oryza sativa)
  misc_feature (71): n=a or g
catttgtatctttaatatatcaatccatgaacagggaaaaggtacaagatgcctgggtaaaccttcgactntgctcgaatctatttgtcacattgagctta

SEQ ID NO: 55781 - DNA, 101 bp, rice(Oryza sativa)
  misc_feature (71): n=t or c
ccacgcccgcacccgctcgagagtgttacacggagctactgctgtttggatggaggctatatgtataactngatttgccataactgtggcaagccacacaa

SEQ ID NO: 55782 - DNA, 101 bp, rice(Oryza sativa)
  misc_feature (71): n=t or c
aactaaggtagcagctgtattcagtgatccagattagtattatccatgttctaagtgcaacatccaccacnaaataaagcagcaatgagtatttggacaag

SEQ ID NO: 55783 - DNA, 101 bp, rice(Oryza sativa)
  misc_feature (71): n=a or g
actttaatcaaaattaaaacgacttatagtctgaacagagggaatagtatttatttgcatatttgacggcntcagcttatacatccatggtttgaaactaa

SEQ ID NO: 55784 - DNA, 101 bp, rice(Oryza sativa)
  misc_feature (71): n=t or c
gcatgccatgaatcaaaatgtggtggggccacacaaaagttgccagggtaaggctgtggctgctgagcttngtttggcagacttgtacccgggaagggagc

SEQ ID NO: 55785 - DNA, 101 bp, rice(Oryza sativa)
  misc_feature (71): n=a or g
gatgctcttgctgatgaaattcaaccacagtggagcataggaattcctacccgccttaatgttgattcacntgggcagataaagagtgttgctatgatatg

SEQ ID NO: 55786 - DNA, 101 bp, rice(Oryza sativa)
  misc_feature (71): n=a or g
tgataagtttgaggaatatgttgatttagtgagaagagatcacccttatttacaagagcaatacattaccngttgttttattgggggactcagaagtgaca

SEQ ID NO: 55787 - DNA, 101 bp, rice(Oryza sativa)
  misc_feature (71): n=t or c
tttaagattgaggagaatattccttggcggtggttgtttgggcgatgaagtccgggcagtaggagcacggnttgatgtaggcgtcgtgtaggtgccgatgg

SEQ ID NO: 55788 - DNA, 101 bp, rice(Oryza sativa)
  misc_feature (71): n=a or c
caaacggcaacaacagcagatagtgctgaatcgatcgatgatagatagcctgatagacaggctaatgattntggggctgggagtggagcagagcagagttg

SEQ ID NO: 55789 - DNA, 101 bp, rice(Oryza sativa)
  misc_feature (71): n=t or c
aggtggtggttggttcagtggtttgtgtgatctttgcgtctgccatgcaaattcgctcttctagaacaatnttctttttttcttttttttccagcgaaaaa

SEQ ID NO: 55790 - DNA, 101 bp, rice(Oryza sativa)
  misc_feature (71): n=t or g
aaaagagaaggaaagaatgtgggacccactgcgtattttttattttaatcggatactcactgacatatggntttcatggtttttctttaggacatttaact

SEQ ID NO: 55791 - DNA, 101 bp, rice(Oryza sativa)
  misc_feature (71): n=a or c
tcgcctccaaattgcccgtatatcgcgctcacctgacaaccgatctgttgatttgcatttcggtttagcantacgtcagaacaagatatttatgcgagcat

SEQ ID NO: 55792 - DNA, 101 bp, rice(Oryza sativa)
  misc_feature (71): n=t or g
gccatgggccgtcggcccagagactttcttgtggaatggtggtcatttttcttcccgaacaagtttagttnaatccctcaatatacgtcgagtttaactcg

SEQ ID NO: 55793 - DNA, 101 bp, rice(Oryza sativa)
  misc_feature (71): n=t or c
atgtaagacaggggctctattgaaataaaatgcaagtataccctgtgtgttgggtcaactctcacactgtnaggtttccaaactccacagcatttttggca

SEQ ID NO: 55794 - DNA, 101 bp, rice(Oryza sativa)
  misc_feature (71): n=t or g
ccacgaagtaaacaaatcagcagcagacaggttcgagtctccattccagaaagaaagagcatatagagatntggattggattgctcatggcagtctgagca

SEQ ID NO: 55795 - DNA, 101 bp, rice(Oryza sativa)
  misc_feature (71): n=a or c
ttctcccagcactgcgagcttgccatggaacacctccgatccttcaagtccgcttcacaaagaccaccccnactgaagcagagacgcgcacagtgtagtgg

SEQ ID NO: 55796 - DNA, 101 bp, rice(Oryza sativa)
  misc_feature (71): n=t or c
caacgaggaaacgaacgaacgtttgttgcagtgtgcgctactgtgccagtactagtactgctgctactacngtgagcctgtgacgttttttacctcttcct

SEQ ID NO: 55797 - DNA, 101 bp, rice(Oryza sativa)
  misc_feature (71): n=a or g
ggcctttcaatagtttctagtcatttatgggatcaatatgcaccatacaatagggagcgataccaatactnaccaataggagtataggactgatctataga

SEQ ID NO: 55798 - DNA, 101 bp, rice(Oryza sativa)
  misc_feature (71): n=t or g
aacatttatatatagaaagtgatactcttcccatttagaggtttggaaaacgtgcacgtcgtaatccacantcataagagaaaacagtgatggttagataa

SEQ ID NO: 55799 - DNA, 101 bp, rice(Oryza sativa)
  misc_feature (71): n=t or c
atgcagctgggccaagttcgcgagtcccagtagagatttgggctttgtgaaatctggagattttatgtggncgaccagtcttggatacggcctggcccatt

SEQ ID NO: 55800 - DNA, 101 bp, rice(Oryza sativa)
  misc_feature (71): n=a or g
cttttgatatcataatgccgaatcccgaatgtatatcccaactgcatgtggtacattatcggataagaggntgttgaattgtcaataaagcttatgaaaag

SEQ ID NO: 55801 - DNA, 101 bp, rice(Oryza sativa)
  misc_feature (71): n=t or g
aatcttccagtcagagaccagaacgacttctatttatttgtatccaatgagcttgtctcagggatcagagngccagaagttgctgaggcagtggcagtgcg

SEQ ID NO: 55802 - DNA, 101 bp, rice(Oryza sativa)
  misc_feature (71): n=t or c
ttaaacagagtacatgggagggaacgacattccctgaaacatcgttttgcaagaaattgacaacaacaaangttaaggaccatcttcctgaaagaaggtaa

SEQ ID NO: 55803 - DNA, 101 bp, rice(Oryza sativa)
  misc_feature (71): n=t or c
gtgatcggttcattattcggagcgcgaattgctgcagagcgaagggtgtgtatacgagctatttattaagnctaattaatttatcattagtaaatgtttac

SEQ ID NO: 55804 - DNA, 101 bp, rice(Oryza sativa)
  misc_feature (71): n=t or c
gaaacgtcttacgaaagcaatgaatcatcagctcttgcatttgttgaaatgccacagaatatcaagctacnagtggagcatctcaccccttgggttcaaaa

SEQ ID NO: 55805 - DNA, 101 bp, rice(Oryza sativa)
  misc_feature (71): n=t or c
tgaatgtcgtcactgtgcccagtcccaccgtaatcatcatagtcttcatcatactcatcatagtcatcatngtactcatcatcgtagtcaggcccagagac

SEQ ID NO: 55806 - DNA, 101 bp, rice(Oryza sativa)
  misc_feature (71): n=a or g
ttcccttgttaggtccattgggccatcaaaaaggaataacatgaatgctacaaaacaacaacacatgaccnggtaaagacaagtctgggccagactgagtt

SEQ ID NO: 55807 - DNA, 101 bp, rice(Oryza sativa)
  misc_feature (71): n=t or c
aaaaacaatccaacaaattggacccagtaactatttcgatggaaccattatcacagcaggatacattaganacactgagctaacgttacaaggatgaaaca

SEQ ID NO: 55808 - DNA, 101 bp, rice(Oryza sativa)
  misc_feature (71): n=t or c
agatgacagaagagagagagcacgctgaagatccggtgctccatcaaattttgaagcagttaaagatgcgnccggacctgcaaaatggaataatggtcatt

SEQ ID NO: 55809 - DNA, 101 bp, rice(Oryza sativa)
  misc_feature (71): n=a or c
gtgtcagcaaaatgttagcagatccatcccaacagtgatctatgttagcagaatcagggctaatgcatgangatctgatgatgatcactgcccctctttga

SEQ ID NO: 55810 - DNA, 101 bp, rice(Oryza sativa)
  misc_feature (71): n=t or c
caccaaaactagcttaaacacctccaggattgaaatagcaaacctgagctagcccatctctgatataggtnctaaatgcttcacttgcattctgaagctga

SEQ ID NO: 55811 - DNA, 101 bp, rice(Oryza sativa)
  misc_feature (71): n=t or c
ggaacttcacctatcaagttgttgaaggagaggttcagatacgtgagaccaataaagctgccaagaaacantggaatgatccccgaaatgttgttgcttga

SEQ ID NO: 55812 - DNA, 101 bp, rice(Oryza sativa)
  misc_feature (71): n=t or c
ttcagcaactaatttaatcagcaccctcaactctactggatctcttcctctgtctctctattgttcatcanttgcagaaaagagtctccttcgtggcgttt

SEQ ID NO: 55813 - DNA, 101 bp, rice(Oryza sativa)
  misc_feature (71): n=a or g
ttgggcaggtgatggttctatctctaactgtcctctacaataagtatctcaaaaagatccctttgaggcgncttgtggctggagttcagacgatgtatgct

SEQ ID NO: 55814 - DNA, 101 bp, rice(Oryza sativa)
  misc_feature (71): n=t or c
acactaacaccattatacatacactccacactcacatatagtacacaattgtaccctctaagagcaggtanaatagtgctattaggaaggctccaaaacct

SEQ ID NO: 55815 - DNA, 101 bp, rice(Oryza sativa)
  misc_feature (71): n=a or g
gagaattaccatttctaatatatacaccctctggaaagtcctccgggattgccccttctatccgcaatatntttgttatttgaccaatttcttcaactggt

SEQ ID NO: 55816 - DNA, 101 bp, rice(Oryza sativa)
  misc_feature (71): n=t or c
tatgacaatgaccttccctcctgcttctctggaaggaattgcctccttgcatcgttttagtatcttcatgnagtcctcatcactccaatcgtgtaggacaa

SEQ ID NO: 55817 - DNA, 101 bp, rice(Oryza sativa)
  misc_feature (71): n=t or c
ccggagaagccccctgaaggatatgaggagaaatggttgatcaatgtgcatgccattgacacaaggggtgngatcgacaagctaggatgcactgagtgcaa

SEQ ID NO: 55818 - DNA, 101 bp, rice(Oryza sativa)
  misc_feature (71): n=t or c
tcaacccctgacctaggtgctgacctcgatacacgagcaggtgcacctaatcgaggagaaggtgcttgccnagatcggggatgtggcacagaaggaagaca

SEQ ID NO: 55819 - DNA, 101 bp, rice(Oryza sativa)
  misc_feature (71): n=a or g
ttggggtctgtctaattaatctccaagatatacaattttcagttagctggtacttccgtcgtcatctctgnattgaagggctctaagggctggtttggttt

SEQ ID NO: 55820 - DNA, 101 bp, rice(Oryza sativa)
  misc_feature (71): n=a or g
ttttacttttttttcctagaatcaattgtttgttggtttcgaccaagtcaatcaaccgttactccattagncatggtattttcctatatgataaaccatat

SEQ ID NO: 55821 - DNA, 101 bp, rice(Oryza sativa)
  misc_feature (71): n=t or c
ctcttacaggtattatcatgaggcctcgttacaccacaaactacgctatcaaaactcaaatcatcataacntccacagcgtctatcgcaaatttgcaacgt

SEQ ID NO: 55822 - DNA, 101 bp, rice(Oryza sativa)
  misc_feature (71): n=a or g
ggggaaagtatccgagagagtttgataaattccatcaagaaaactgcagcagcagccaccagcaggagtanatgaggggaggatgaggtgaggcagcagtg

SEQ ID NO: 55823 - DNA, 101 bp, rice(Oryza sativa)
  misc_feature (71): n=a or g
ctaacccgtgaaactattctctcatgcaactactagcacaatcataacctgccattttcctctacttttanataatcgatgcatacgttacttgtctacgt

SEQ ID NO: 55824 - DNA, 101 bp, rice(Oryza sativa)
  misc_feature (71): n=t or g
aagttcatgtcacaccttacctgcatatcaacaattaatttatcgacaacacatcattcaaagaacagggnaacatatcatcaagtaataaccctgaaaat

SEQ ID NO: 55825 - DNA, 101 bp, rice(Oryza sativa)
  misc_feature (71): n=t or c
ctcatagaagaggccaatgcagttttggtcagagctcctatgatagcacacctttcagtaaatatttgagnttcaaggaaatttagttcatgtataatttg

SEQ ID NO: 55826 - DNA, 101 bp, rice(Oryza sativa)
  misc_feature (71): n=t or c
catgcgtccatctggatttgatcgtgagaaaaataacactcccatacagtggaagctaggttcagatggtnggatgcagatgagcaagcctgagagttaca

SEQ ID NO: 55827 - DNA, 101 bp, rice(Oryza sativa)
  misc_feature (71): n=t or c
gggaatttttaggtggtgaatgggtgattgataggtggtggtggtgtaggaaggaatggttggggaatgcnagtatactagtactacctatgattgctact

SEQ ID NO: 55828 - DNA, 101 bp, rice(Oryza sativa)
  misc_feature (71): n=t or c
tttctttaaaatttcttcgtaccaaaagagcttcgtagttgaactgcatcgtgtatagtaataacatggtnagtactagtggagcagtgtgcttcattcaa

SEQ ID NO: 55829 - DNA, 101 bp, rice(Oryza sativa)
  misc_feature (71): n=t or c
gcggtgtactcccttggtacccatgagcaaaacctctccccggaaaatccccaaactcttgatggttgaanacagatctaggggatttgggaaaaggagac

SEQ ID NO: 55830 - DNA, 101 bp, rice(Oryza sativa)
  misc_feature (71): n=a or c
aaatacatcactgcaatgaacaaaaaacacagagatactatcacactattcaactaaatctgcagccaagntctagattcctctgtcaggtcgggaaataa

SEQ ID NO: 55831 - DNA, 101 bp, rice(Oryza sativa)
  misc_feature (71): n=a or c
aacgtgatgcccaccacctgttcggtgaaatgccgagccaattgggacatgactcaagtgctgttcttcangtcgctgtgagccatggtctattcccggtg

SEQ ID NO: 55832 - DNA, 101 bp, rice(Oryza sativa)
  misc_feature (71): n=a or g
acatgatatctcataagtatcaaatcatgatacctacctaacatactgatttcaactatatcgtttgaacngtattgccattttatagtatttttgttaat

SEQ ID NO: 55833 - DNA, 101 bp, rice(Oryza sativa)
  misc_feature (71): n=a or g
ttaatcgtggcctgcatttgtacacttggccatttttccagatgcatacgatcaacagtatcactggtctnacagtataatacctagaaagacacaattaa

SEQ ID NO: 55834 - DNA, 101 bp, rice(Oryza sativa)
  misc_feature (71): n=a or c
tcacttgcagcacaagccagaatcctgcagcattcaagctcacaaaggcgacagagttaaagttcactacngtgtaagtttgatattctgctgtatggcct

SEQ ID NO: 55835 - DNA, 101 bp, rice(Oryza sativa)
  misc_feature (71): n=a or g
ttcactggttacaccagaaggaaacatagaggagatgctcaaggagcatgacaggaacatccaagcagccntgcgcaaagcacgccttaacaagaagaaat

SEQ ID NO: 55836 - DNA, 101 bp, rice(Oryza sativa)
  misc_feature (71): n=t or g
ggtgcaagtgggagagtgaatgagctggagtatctgtaaaacaaggtcaaaatttcagttttggcagattnaattgtttggaaagttttaaaatggcctag

SEQ ID NO: 55837 - DNA, 101 bp, rice(Oryza sativa)
  misc_feature (71): n=t or c
aaagccaaaagcgaggtagctcaatattctttgcaggcagaactggtggcactgcaactagctatggagantgccaaattcttcaactttgcaggcactag

SEQ ID NO: 55838 - DNA, 101 bp, rice(Oryza sativa)
  misc_feature (71): n=a or g
atccatgtcctctataggaatgtcaacctcatcgatagacatgtcatcttctgcagatttcgggagtggcngcgcactaggctcagagcctggcatggcag

SEQ ID NO: 55839 - DNA, 101 bp, rice(Oryza sativa)
  misc_feature (71): n=a or c
aggagtccggttcggattcattgtggctggatgtggctgcggtattttgagaggagaatacagttttggtnaattgtatttgatttggaaattgagggatt

SEQ ID NO: 55840 - DNA, 101 bp, rice(Oryza sativa)
  misc_feature (71): n=a or g
tcggttccaaaataacctcattttttacccatctcacacaaacacaaaccaatacttcttcctccatcccnctcaataagctaggcacgtacacacacatt

SEQ ID NO: 55841 - DNA, 101 bp, rice(Oryza sativa)
  misc_feature (71): n=a or c
cagtacacaagttcgtgcatcagtctgtgcactattgcatataccttgcgtcttcatgtactgctaacttnatttactcaataagcatgggccagtcagac

SEQ ID NO: 55842 - DNA, 101 bp, rice(Oryza sativa)
  misc_feature (71): n=t or c
aaggaccttccacacaaagttgaacacatggaagtgaaagggaggaggatcaatgaaaggatcttgatgtngtttagaggagggtgaataggcgtttaaaa

SEQ ID NO: 55843 - DNA, 101 bp, rice(Oryza sativa)
  misc_feature (71): n=a or g
acgtatacattcaagacttcgggttggccatagcttcgttgaaacaaaagtagaaataacctaagtgagcnatagtttaactgattaggtttcttgtgata

SEQ ID NO: 55844 - DNA, 101 bp, rice(Oryza sativa)
  misc_feature (71): n=a or g
atgtcccaaaatccaaattccaggcagcaagaagatggaatggcaaagcttcaatatgatgcccaggacgncggcggtggcgatggcgagttggcgacagt

SEQ ID NO: 55845 - DNA, 101 bp, rice(Oryza sativa)
  misc_feature (71): n=a or g
cagtctctgtaggtagttgtattgtcgcctgaaaataagtaccagtgccacgccatggcgtgaatctggcncatgggatcggaagggctgaagtggtggtg

SEQ ID NO: 55846 - DNA, 101 bp, rice(Oryza sativa)
  misc_feature (71): n=t or c
ttagcgtgaactaaacacaccctgagaagtgagatcgaactcgattttccagtccgcctttatattattantggtctagaagcatgagacgagcagtacta

SEQ ID NO: 55847 - DNA, 101 bp, rice(Oryza sativa)
  misc_feature (71): n=a or c
ggtaaaaaaaagcagatctattaccactggagagagaagaactaggaggaagaagaggacattgcaaagcncaagaaaaacacacacatcttcatcttgaa

SEQ ID NO: 55848 - DNA, 101 bp, rice(Oryza sativa)
  misc_feature (71): n=t or c
tgcatgcattaagttcgagaatttgttttgtacccgtatatattcgtacttctgtatatagtacggggaangtactatattcgttcatcaatcggcacggt

SEQ ID NO: 55849 - DNA, 101 bp, rice(Oryza sativa)
  misc_feature (71): n=t or c
atttgacgttgtaaaaaagaagagagataactagataagcgcaactgatgctctatacttagtttcacggntcttggtttaatgcctaaaaattgtgcact

SEQ ID NO: 55850 - DNA, 101 bp, rice(Oryza sativa)
  misc_feature (71): n=a or g
ttaaataagacaacgttgacataaacagtgcaaaattgcacttagatcatgtttgagggagtttctaactnttgcagtttctcttagaatcagaaactcct

SEQ ID NO: 55851 - DNA, 101 bp, rice(Oryza sativa)
  misc_feature (71): n=a or g
atcagtcacacaatttaacaaatttcacaaacatcagagttcaaagcctggatcaagctgtgatgataatnacgacttcaacgaaacaaataactgcatgt

SEQ ID NO: 55852 - DNA, 101 bp, rice(Oryza sativa)
  misc_feature (71): n=a or g
atatacgtactaaatggtttcctcttcttcttcttcttcgctatgaactcatcaaggagacaagaaggganccccctggacctgaacaacctgccggatga

SEQ ID NO: 55853 - DNA, 101 bp, rice(Oryza sativa)
  misc_feature (71): n=a or g
gccacccggtcacgcaaaatacgactagcacttgtgatgccatctggtgttgtggttctgtactctgaacngactggtgaagctgacgaatacctactagg

SEQ ID NO: 55854 - DNA, 101 bp, rice(Oryza sativa)
  misc_feature (71): n=t or c
atgttcctccagcgcaaccgcctcaggaaccgaaaaaagagaaaaatttcccagccgcccaacgtcacgangtcctcacttccaaacccaaacggcaaccg

SEQ ID NO: 55855 - DNA, 101 bp, rice(Oryza sativa)
  misc_feature (71): n=a or g
tactctctccagtaatttctattgagtaatattaagatgcgctccatatatagagacaggggcggagctanagcgaaatggagggtagtgccacttactta

SEQ ID NO: 55856 - DNA, 101 bp, rice(Oryza sativa)
  misc_feature (71): n=t or g
tacccggattcttgtcttgtttctaggttaacttggaagcatgtctgtcgtcatgcaccccatgttgcctnactcgatctagctgtcatcaacgagacaat

SEQ ID NO: 55857 - DNA, 101 bp, rice(Oryza sativa)
  misc_feature (71): n=t or c
tggaggaaaaaggaccggtggggtgatgaggtggacattaagagcgagttgcgagagacaaagaaatgttnacttaatgcgtcttaaagtcagagtattca

SEQ ID NO: 55858 - DNA, 101 bp, rice(Oryza sativa)
  misc_feature (71): n=a or g
acaaaacacaatcagatggtcacttcttcattgttgaaggaatgctcaattgcagcaagctgtagtacatngaacaaaaaacaaacagatgatcacttatt

SEQ ID NO: 55859 - DNA, 101 bp, rice(Oryza sativa)
  misc_feature (71): n=t or c
agaaaccatctataatcggttgcttaaaaaccacgataatcccagctgcttaaaaatttgggactataaanatttttagttccggtttacaagcacaatgg

SEQ ID NO: 55860 - DNA, 101 bp, rice(Oryza sativa)
  misc_feature (71): n=a or g
gcatagaagaaatagtcggactattttttggggtgagaacttgctgtattgcaccaggctgtaattggctnccctatagtcagaccaatgtggacaggcat

SEQ ID NO: 55861 - DNA, 101 bp, rice(Oryza sativa)
  misc_feature (71): n=t or c
cggtgagaatactcagcttttcctggcagcttagaaagcgtccgtctgcatgcaatgccacaatgacggcngtggcaaaagccaccgagatgcggagcttg

SEQ ID NO: 55862 - DNA, 101 bp, rice(Oryza sativa)
  misc_feature (71): n=a or c
acagtaacttgtgtggacagttttggtcaagttcacaccgactaggcaaattgttgtacatgttattctanctatttgtacataacatacaagtttttact

SEQ ID NO: 55863 - DNA, 101 bp, rice(Oryza sativa)
  misc_feature (71): n=t or c
gttacgcttgtcatactgaagataaacataatgttgcaggtgcttgtgagaacacttcgtgccgaatctgnggacagacaaatgctggcggcagttttatc

SEQ ID NO: 55864 - DNA, 101 bp, rice(Oryza sativa)
  misc_feature (71): n=t or g
ccattggtgtgaaggtacaaattcgagagatgtttcaagctggcaccaatctcacgtgggatcatacctcncagttggttgtggctgaggtctagcgatgt

SEQ ID NO: 55865 - DNA, 101 bp, rice(Oryza sativa)
  misc_feature (71): n=a or g
aaaaatcactttctctcactcgcatcccttaataagaactggcattgatgaacaccttagagcatctccantaatagctcctattttagaatccctaaagg

SEQ ID NO: 55866 - DNA, 101 bp, rice(Oryza sativa)
  misc_feature (71): n=a or g
ttggaattgcctcggaattcattagggatgttaattttcacacatgatactcacgcacacgctctcatctntcgtctctataaatttagaccgtgttttgt

SEQ ID NO: 55867 - DNA, 101 bp, rice(Oryza sativa)
  misc_feature (71): n=a or g
ggaacgaggtggcagctagatagatcaaaacacagcaatgggtatgtataacactgttgggtagtgtttgnttgcaaggtttgggatggaatgcgatggga

SEQ ID NO: 55868 - DNA, 101 bp, rice(Oryza sativa)
  misc_feature (71): n=t or c
tccaaaactacattaaagaagaggaatatggaaattacctgaatcacaagttgagtcaggtttggagcggnccttaggaagttaagcgtagacagaatcgg

SEQ ID NO: 55869 - DNA, 101 bp, rice(Oryza sativa)
  misc_feature (71): n=a or g
ataatcgatgcacaggcatgaccagcaatatatagacttcatccagattactcgtaactgccaaggatttngagtcctggccgatgacggtttagctttgg

SEQ ID NO: 55870 - DNA, 101 bp, rice(Oryza sativa)
  misc_feature (71): n=a or g
atttataggttatttagtaaagattaaggtttagaaaaatgagtataataacctatcagatgtatggttgntatttaggggtagaatatataaaattctga

SEQ ID NO: 55871 - DNA, 101 bp, rice(Oryza sativa)
  misc_feature (71): n=a or g
taatacatgttgaattataaaaggtaatataaataaagagacctagtggcctctgtgtgtgtgtgtgggtnggtgggggcgtgatatataaccaggcgcat

SEQ ID NO: 55872 - DNA, 101 bp, rice(Oryza sativa)
  misc_feature (71): n=t or c
acgtaatctccagttctacatcatccaatcagatcagatagataatcatcgcaaaaggcatgtagcccagnggttacagtgacatgagtagcgctccaaga

SEQ ID NO: 55873 - DNA, 101 bp, rice(Oryza sativa)
  misc_feature (71): n=a or g
atgtatgtgatccaggggagggccaaatcgcataaagtaagatgaaactgcagctaaaaatttgccgacgnttacgccgccgtacgtcgagttcttccgta

SEQ ID NO: 55874 - DNA, 101 bp, rice(Oryza sativa)
  misc_feature (71): n=a or g
ctgactcctgaagctctatcttgtctgcaccagggggtatgctccaagtgaacccttgtagaagccttgcnaatagcatcattgtaattgaagtgccaagt

SEQ ID NO: 55875 - DNA, 101 bp, rice(Oryza sativa)
  misc_feature (71): n=a or c
tatccaggtaacataccgatatttagatggcacttaccctacatcgaagatgggtatccaaaacgtgtcgnatgtctgtgtgaacaagtcaaaggaaccaa

SEQ ID NO: 55876 - DNA, 101 bp, rice(Oryza sativa)
  misc_feature (71): n=t or c
aaaaaagttctctccatttcacagtactttgcaattttgagttggcattttttcagtgtgaacatttatantctaaagataaaatcataggtattaataaa

SEQ ID NO: 55877 - DNA, 101 bp, rice(Oryza sativa)
  misc_feature (71): n=a or g
tttttatttcgggatgaatttatcaggacgtgacaccatggacactcaagatgtagcaatgattgaagccnactggagagagccccttatacgatttctga

SEQ ID NO: 55878 - DNA, 101 bp, rice(Oryza sativa)
  misc_feature (71): n=a or g
gaaagccgctgaaccattcacttcttgttgctgcaggagagaccgaggtggatgagaatcagctctctcgntgagctcaaaacgaagctgggccacatcat

SEQ ID NO: 55879 - DNA, 101 bp, rice(Oryza sativa)
  misc_feature (71): n=a or g
ctcaagaagtttgaggaagatgaagcaaaagaaaccgcgttgagatcaaaacgtgaggccacatggaagcncctagaagagattgcctcgtcaaaaactat

SEQ ID NO: 55880 - DNA, 101 bp, rice(Oryza sativa)
  misc_feature (71): n=a or g
tgactctgcacacaggctcggtgacgttagcccatggtggtgacaacggctagggttgcggctcagtgacnacgatgacgacatccttggcggccagcgta

SEQ ID NO: 55881 - DNA, 101 bp, rice(Oryza sativa)
  misc_feature (71): n=a or g
aacaagaaatcagtttagtgcatgcaaactcaatattgcgtacttaggctgtgtttgataaaagaagaaanacgaaaattgagaagatacgtaaaatgagc

SEQ ID NO: 55882 - DNA, 101 bp, rice(Oryza sativa)
  misc_feature (71): n=a or g
gccatcccacaaggtggtgatgaaaatgttttgtgccgtcccggataagctggagcacatcgccacatcgnttgagactctcttggatctctcgaccctga

SEQ ID NO: 55883 - DNA, 101 bp, rice(Oryza sativa)
  misc_feature (71): n=t or c
aaaaaacaaaatgcaaacacttgggaggttgaaactgcaaaatagcacaaggatttagggcgaattttctncccctcttccagtagtttccaccttttccc

SEQ ID NO: 55884 - DNA, 101 bp, rice(Oryza sativa)
  misc_feature (71): n=a or g
cgatttgcggcgatggcacgggcgtctcaccgaggtaaacgagcattgaaaaaagaacgtaaatattaggnaagaatctaatatcaaataattagaagggg

SEQ ID NO: 55885 - DNA, 101 bp, rice(Oryza sativa)
  misc_feature (71): n=t or c
acttaatgtacttttgttttgtagattcaagcgacgatgatgataagattcaatattttgatgacagcacnaccaatccttccccccgatttgttgtcata

SEQ ID NO: 55886 - DNA, 101 bp, rice(Oryza sativa)
  misc_feature (71): n=a or g
tgagatctctgtctagtgttggtggttattagtttgtacttcgtttcctgtttattggacgttttattatngacttgttggtgtgtgctcatcgttgagca

SEQ ID NO: 55887 - DNA, 101 bp, rice(Oryza sativa)
  misc_feature (71): n=a or g
tctggatagagcaatgaatattggtttgttaaccaagccaataattgatcagggtggaggagatttccctnttgttcaatatgctgatgatacacttgtct

SEQ ID NO: 55888 - DNA, 101 bp, rice(Oryza sativa)
  misc_feature (71): n=a or g
tgagtatctatcatcttcgttctaatctctccaaagcggaatggtttggagtgaattgtactagaaaattntaatattaacaaatatgattgcatccttaa

SEQ ID NO: 55889 - DNA, 101 bp, rice(Oryza sativa)
  misc_feature (71): n=a or c
cccctcaccaaccaggctagttgttggtcaatcgtctcgtgtcagggttgtggatatataatgcatacctnttatccttggggtcgtgagatatatggata

SEQ ID NO: 55890 - DNA, 101 bp, rice(Oryza sativa)
  misc_feature (71): n=t or c
actgtctcgttgggcttgatattgttcgtgtggagctgttattgtccatgggccgagttactgttcacagngaacaacagcagagggcaagaacaatccag

SEQ ID NO: 55891 - DNA, 101 bp, rice(Oryza sativa)
  misc_feature (71): n=a or g
tctagatttactgtactagacaatctaggagggaatgtgacacggggtatccagattctttggactagaangtatcggttgtcattttttttttgacggag

SEQ ID NO: 55892 - DNA, 101 bp, rice(Oryza sativa)
  misc_feature (71): n=a or g
aagtccagttctatcaggcggctgcacatctaacctttgaaagcagtttgttttcattttggttgaaattngaacgatatgacggaaaagttagaagttta

SEQ ID NO: 55893 - DNA, 101 bp, rice(Oryza sativa)
  misc_feature (71): n=t or c
aggtgagaggacaaaagaaaaccaaagttattgcttgcactccttaactattgcttccaagtttctatcantgtataccaacattacatcaagcataaaag

SEQ ID NO: 55894 - DNA, 101 bp, rice(Oryza sativa)
  misc_feature (71): n=t or c
tgaaacattttcagataatgaaaactgcgtgctgagtgttgctaaggagacagagcataatgatttcaacnctgtgaattgtatctcacaagattcagttt

SEQ ID NO: 55895 - DNA, 101 bp, rice(Oryza sativa)
  misc_feature (71): n=a or g
aaatttaactcatgttgtgagttaacgtttaactatatatcctccacacgagccatcccatgcgccaaccnttgtgagtcaaacttttatcagatcatgtg

SEQ ID NO: 55896 - DNA, 101 bp, rice(Oryza sativa)
  misc_feature (71): n=t or c
agaatcttcatattgctccggtttgctatctcagcatcaaatatttctccacctccaatgaggttaatgtnaccttttcttaccctttttcgagctattag

SEQ ID NO: 55897 - DNA, 101 bp, rice(Oryza sativa)
  misc_feature (71): n=t or c
tactgtaattaaaggaagaatcttcccatcgggcgccagatgccaaaaaaataattcggtcggtcaaatgnttcaattaaccaacgagtgaaacatcaagt

SEQ ID NO: 55898 - DNA, 101 bp, rice(Oryza sativa)
  misc_feature (71): n=t or g
ttgagtgggccaagagcccaacactggccaggacctgataataagattactaggactacttagccctatcngagaatccgctggttggcaaccagcttcta

SEQ ID NO: 55899 - DNA, 101 bp, rice(Oryza sativa)
  misc_feature (71): n=t or c
cgccatcctcgggtcgctgcaggggatggagaagtggattccatcggtggacgctagcgtgaaggaactangacaagctgtagatcaagtcaacttccaag

SEQ ID NO: 55900 - DNA, 101 bp, rice(Oryza sativa)
  misc_feature (71): n=t or c
agtttgcatttcatcttccacattaaaaaaatgagagggatggatgccaaacataaggccctgtttagttnccaaaacaaaaattttcacgctgtcacatc

SEQ ID NO: 55901 - DNA, 101 bp, rice(Oryza sativa)
  misc_feature (71): n=t or c
gctctcgaacatccccgacaggtcgaacccggaggacatggaggatatgagctggaacgcgttgcacgtcnggggcgacatggcgccggagtcgccgccgt

SEQ ID NO: 55902 - DNA, 101 bp, rice(Oryza sativa)
  misc_feature (71): n=t or c
tggtggtacatgtatgatgcgatatattgtaggtcagcttgacttgttgcgagttggcaaaaagaatgacnggatggcgatatccgatagggtggatggag

SEQ ID NO: 55903 - DNA, 101 bp, rice(Oryza sativa)
  misc_feature (71): n=t or g
tatcagtgaaaagttgtgttcatcgaaaggaaagaaaactaaaatcaactagctgcaatttcgacgggggnacaaatgcttcagaatgagggtggaagtag

SEQ ID NO: 55904 - DNA, 101 bp, rice(Oryza sativa)
  misc_feature (71): n=a or c
tccccttaaagagcggcttgtccccaagccggtgcttcaggaaagtggtgacgcagttgatgaagattctngcatttcgcaagctcatcagggagaccagt

SEQ ID NO: 55905 - DNA, 101 bp, rice(Oryza sativa)
  misc_feature (71): n=a or g
taaatttagttctctaatattttggcaagatggccaataaatttagagagctagatttggagaggccgttngagatgttttaaggagtttattataagtta

SEQ ID NO: 55906 - DNA, 101 bp, rice(Oryza sativa)
  misc_feature (71): n=t or c
gacaaggtttcctccccctgcaaacctttcagccattcaagagatagcagccctgaaaatgggcattgctntgcagttgcttctcctcctctcgaacctct

SEQ ID NO: 55907 - DNA, 101 bp, rice(Oryza sativa)
  misc_feature (71): n=t or c
ttttagcttgtcttttatgcatcgccctgatccatcaaatgagcaagaaagaattacttctttgtctgggntgcaatggcggatcggttggtggtgccggc

SEQ ID NO: 55908 - DNA, 101 bp, rice(Oryza sativa)
  misc_feature (71): n=a or g
tgggatggcttcttttgcccaatcattcacattcatcttggtgttccattgtatgtgtatgtatgtcctancctgacaaaatatatcacattaataatttg

SEQ ID NO: 55909 - DNA, 101 bp, rice(Oryza sativa)
  misc_feature (71): n=a or g
aagcaaaggagcttgcccagtatgtttggcaatttccagagttccatttgctgccttacctaaagaaaggnaaaaagaggaggtgagtcacagcttcacaa

SEQ ID NO: 55910 - DNA, 101 bp, rice(Oryza sativa)
  misc_feature (71): n=a or g
ttattacaaattagccaaaaagtgtttattacaagtatcccccgcgacaaacacatgcatttagtccacancatgttccctctcccactctcttaggttct

SEQ ID NO: 55911 - DNA, 101 bp, rice(Oryza sativa)
  misc_feature (71): n=a or c
gatgtcccacatgcatggcaggtgtgcgtacgggcatgccgttatcaaagacatcacactggtagagaaancatctttggtcggtcgacccaaatccacaa

SEQ ID NO: 55912 - DNA, 101 bp, rice(Oryza sativa)
  misc_feature (71): n=t or g
aatctttttgtcactggttttttctcacgtgcgctttttttttctcatccagtattttaatcccatctgtntgccgcacgcctcccgaggagaaccctagc

SEQ ID NO: 55913 - DNA, 101 bp, rice(Oryza sativa)
  misc_feature (71): n=t or c
aatccagcccaaagctctcccttcctccttcagcccgctgccaaagtctccttttgtatcatacccttccncctctccctctctttctccaccaacctctt

SEQ ID NO: 55914 - DNA, 101 bp, rice(Oryza sativa)
  misc_feature (71): n=a or g
acacttcaccaacgattttcacttgggagtaaacaaaattagaatgcattttctgatcgccaaatcaagtntggaatccagcaagttaatcggtgtgtgtg

SEQ ID NO: 55915 - DNA, 101 bp, rice(Oryza sativa)
  misc_feature (71): n=t or c
tcctctggaacgcttccgcaaaatattcgggcaacatctctcaatctttgttacagcagcaccataagctntagatctttccctgcaaagatactcataat

SEQ ID NO: 55916 - DNA, 101 bp, rice(Oryza sativa)
  misc_feature (71): n=a or g
agatcctttttgccatgccatgggataaacctaaatatgtcagcattaaggatgaatggtgtgtaggattnaacaataagaactaagcctaccagagaagg

SEQ ID NO: 55917 - DNA, 101 bp, rice(Oryza sativa)
  misc_feature (71): n=t or c
attaaggcaatgaagctcaagttatgtcttgttcaatttgatactggtaactgggagagatatttgtgtgncctaaatctcaatgtgtattggctcttaat

SEQ ID NO: 55918 - DNA, 101 bp, rice(Oryza sativa)
  misc_feature (71): n=t or g
cttgggggtcggtaccttcttcttgccctgaatcattttaagaacatcctgcatggttggcctctctgtcnctttgttctgggtacagagcagtccaatat

SEQ ID NO: 55919 - DNA, 101 bp, rice(Oryza sativa)
  misc_feature (71): n=a or g
ttttttttcatgttttatagatcaatttacattttttttattttatttgggaaaccaactaaacagctcgnagcattttcgaggaaaactatatatattct

SEQ ID NO: 55920 - DNA, 101 bp, rice(Oryza sativa)
  misc_feature (71): n=a or g
gatatacagaatatacaattaaagatcaactcagatttcattcacaatttacccttctataaaaaattgcngccacgtctgcaaatgaagacttcaaatac

SEQ ID NO: 55921 - DNA, 101 bp, rice(Oryza sativa)
  misc_feature (71): n=a or g
atacaaactcaaaaccacaactctctcgcatacacacacacgaaaatcatggatttggggagaaaccactnagtgtccgtctcgcacaggaacatggtaga

SEQ ID NO: 55922 - DNA, 101 bp, rice(Oryza sativa)
  misc_feature (71): n=a or c
catatattgctgcatttcaggtgaagatgagacttcgagtagtttggaacagtcgacacttgttaatgaangtgtaggtttctttcataattgcctggata

SEQ ID NO: 55923 - DNA, 101 bp, rice(Oryza sativa)
  misc_feature (71): n=t or c
tgcaaatataatactgctgctactactaacactgcgtgactttcagatgcctcctgcctcagcaggaattnacatcagaacagaagccggccgccaccatt

SEQ ID NO: 55924 - DNA, 101 bp, rice(Oryza sativa)
  misc_feature (71): n=t or c
aaggagctaattaggataagacacacaaaagaattctctgttagtttttcagtggtacacagattggagtnggagcagaaatatcagcaaaagctccaaac

SEQ ID NO: 55925 - DNA, 101 bp, rice(Oryza sativa)
  misc_feature (71): n=a or g
aaactgattcacgccaccagtattcatggcataggcattgctagatgtaggcgcaccgtgaccgcctaccngatcggtgaaaccagcattaggggcaagat

SEQ ID NO: 55926 - DNA, 101 bp, rice(Oryza sativa)
  misc_feature (71): n=a or g
aacataagcccttttgaattgtgctttggtttgggtcggataggtgttgtgtgacttagtgtttcttggtngagttggagttgccgatcacatgggtgatg

SEQ ID NO: 55927 - DNA, 101 bp, rice(Oryza sativa)
  misc_feature (71): n=t or g
tttctagtttaagcgaacttaactgcgatcacgttgcaaacggcagaagtaaacaagaagaaattaccacncaacttctttcgtagggtgtccttggtctg

SEQ ID NO: 55928 - DNA, 101 bp, rice(Oryza sativa)
  misc_feature (71): n=t or g
gtttttttaaaaaagtttggtttacagcccatgtatcatgtcagttcttgcaaaaagggagagtgcgtacngtgttggatccagtcctataaggcctaggc

SEQ ID NO: 55929 - DNA, 101 bp, rice(Oryza sativa)
  misc_feature (71): n=a or g
ggtgatggcgtggcctgtcgtcgctggtagacgtgcgggaagggctcgaccagctttgccatagtcggtanaagaggtccagcggccggccgtgtcgagaa

SEQ ID NO: 55930 - DNA, 101 bp, rice(Oryza sativa)
  misc_feature (71): n=a or g
cagtgaaacacagtgcaacaactttgaagctctcatcagccattctttttgagaatctccaaaaaaaaaantcaagactatactcactacagagtatttta

SEQ ID NO: 55931 - DNA, 101 bp, rice(Oryza sativa)
  misc_feature (71): n=t or c
ctaaaattagaccctaaataatttcataggcatataatgatattaggtcttttgataaatattcaggggtnttccggctaactccacaaggtggtgagctc

SEQ ID NO: 55932 - DNA, 101 bp, rice(Oryza sativa)
  misc_feature (71): n=a or g
ttcttcttcttcttcttctccatatctcctactcctcgtgaagatcgatcgaccatcggcaatttcattcngtaatagttaagctaagatcaaatcaagat

SEQ ID NO: 55933 - DNA, 101 bp, rice(Oryza sativa)
  misc_feature (71): n=a or g
agttgagatattttgggatggatgaagtataatacaattagctggcatcgacttgggtcggtttggcgacnttgttttgattatatgctagaaaagtaaag

SEQ ID NO: 55934 - DNA, 101 bp, rice(Oryza sativa)
  misc_feature (71): n=a or g
tgaggcgccatacatcgacgggattcacccgtgctacagtaggttgtcgtcatcgtcatcctcgccagtcngcaacccggcgaacgacgcctccacgtctc

SEQ ID NO: 55935 - DNA, 101 bp, rice(Oryza sativa)
  misc_feature (71): n=a or c
tcactagattaaatttagttttgaggataaatcgaaaataccttttcatggcacccaaacgaagccttgantcaatgggcaaccttttcaacttgggtctg

SEQ ID NO: 55936 - DNA, 101 bp, rice(Oryza sativa)
  misc_feature (71): n=a or g
accggtgtaggggtccttggtgacggaggtggttggagatggtggcaatgtgcttctaggacgatgaatcncatctccggtggtggagacaccctcttgct

SEQ ID NO: 55937 - DNA, 101 bp, rice(Oryza sativa)
  misc_feature (71): n=a or g
gtcgcaccaaaccccgtagctgtcaccgtcggatttgccagtggagccaccgaatttgggaatcacagtcnccggcgaggaggtgttggcggcgagaccgt

SEQ ID NO: 55938 - DNA, 101 bp, rice(Oryza sativa)
  misc_feature (71): n=a or c
aatacacttttcttattagtagtgcgttagcgtaggaatcatcctaacacttctaacgttggagaaaaaanaatagagtttggtagagaggagaaccaaaa

SEQ ID NO: 55939 - DNA, 101 bp, rice(Oryza sativa)
  misc_feature (71): n=a or g
aggagagacgatatattcagttttgtatttgagggagacgattcaatcagaagtaagagatgagggaggcntaatagacgtatttccaaaagttcactgct

SEQ ID NO: 55940 - DNA, 101 bp, rice(Oryza sativa)
  misc_feature (71): n=t or c
ttaggaatgagtgtgtgcgcgtgttgtgagtggctacatttaactgtgtttctttaaaaaaagaaaactanatataacaaccaactttattgaataattct

SEQ ID NO: 55941 - DNA, 101 bp, rice(Oryza sativa)
  misc_feature (71): n=t or c
atttgtgtaaagctcaattataaccatgccactgtttccaactataacataatgtgtgctcctcactgccnctttaagtgttcataatatgcccacaagtt

SEQ ID NO: 55942 - DNA, 101 bp, rice(Oryza sativa)
  misc_feature (71): n=t or g
aacaactaacccacttgtgtatatctcggccgttgagccccttaatgggaataattaaggctcatggcganagaagattgagatagcacttgcgctgtcta

SEQ ID NO: 55943 - DNA, 101 bp, rice(Oryza sativa)
  misc_feature (71): n=a or g
ggatggcatggtgttgtgttggttaggcatgatcggcattgggaccggtaggccattgttgttggcatcgncaccggtgtagcggacgaggccacgagaga

SEQ ID NO: 55944 - DNA, 101 bp, rice(Oryza sativa)
  misc_feature (71): n=a or g
ttttttatcaatacccctacagagatccggaaaggttgaatgcgacgaacttgggcatttgtttaagatcnaaggggatccctcccaaacttcttggagag

SEQ ID NO: 55945 - DNA, 101 bp, rice(Oryza sativa)
  misc_feature (71): n=t or c
gggccctatcattcttgggcccacatgtcagccaccaaatcagtgaaagttacgttagaggatctcaatcnggtgcagtagcggcgaccagcatgcggtgg

SEQ ID NO: 55946 - DNA, 101 bp, rice(Oryza sativa)
  misc_feature (71): n=a or g
attatcttgctcctgtgttgtccgattgacagattgtcactaaccaacaagttccatgagcagcttaggangcaaaaggtagctaaattgtaggtggaagt

SEQ ID NO: 55947 - DNA, 101 bp, rice(Oryza sativa)
  misc_feature (71): n=t or g
tgccgggtatgtatatatcttcactagatttaggatgtgtttaattagattatgggtgtaaaattttagcntgtcacatcggatatacggacacatatttg

SEQ ID NO: 55948 - DNA, 101 bp, rice(Oryza sativa)
  misc_feature (71): n=t or c
ttgcatctttagatacaccatgtctccctcctgaaaacttctttcagacctaagtctgtctgcaaatttcntgattcgattctgagccctcaacaagttat

SEQ ID NO: 55949 - DNA, 101 bp, rice(Oryza sativa)
  misc_feature (71): n=a or g
gggaggacgaaggaacgccaataccgacattgctcaagctcattatcatcatctccgggtgggagaatcancgcatataaccatccccatctcttcttcct

SEQ ID NO: 55950 - DNA, 101 bp, rice(Oryza sativa)
  misc_feature (71): n=t or c
aacatcatgagacggcgcatacctgcaggagagccggcgagtcgaaggtacaggttctcaccaacggcacnggctttctccgagtcgagaagctcccccat

SEQ ID NO: 55951 - DNA, 101 bp, rice(Oryza sativa)
  misc_feature (71): n=t or c
ggacttctcatggaccgctttccattttatgtaccacatatatagcccggaaaatatgcagtatgcaaatnacatatgtagtggaaatttaaaaactacag

SEQ ID NO: 55952 - DNA, 101 bp, rice(Oryza sativa)
  misc_feature (71): n=t or c
atccgtgcaagaccgaaaccagctatcttggctttgaggttgccgtcgagcaaaatgttggtcggcttgangtcgcggtggatgatggggcttttgcaatc

SEQ ID NO: 55953 - DNA, 101 bp, rice(Oryza sativa)
  misc_feature (71): n=t or c
cacgcggagaagaagtgacgacgctcatgccgtgcacctgatccattgctggatccgccgtcgccgagcancccgccacccgctgccgtcgccgatcccgc

SEQ ID NO: 55954 - DNA, 101 bp, rice(Oryza sativa)
  misc_feature (71): n=a or g
ctgaaacccacatgcatgcatgcctgcctgctattgtgttgtctgaatacgaaatatgcggggggtctctngcttgccttgccccgcgctgttaggagtag

SEQ ID NO: 55955 - DNA, 101 bp, rice(Oryza sativa)
  misc_feature (71): n=a or c
tactgtatgtttcagaaaatgttgaaaaaactatctggacgggtaatcgtgattggttcacaattcctcgntgatgatgaggatagagaagatattgaaga

SEQ ID NO: 55956 - DNA, 101 bp, rice(Oryza sativa)
  misc_feature (71): n=t or g
gcgtaagggtgaacaagtgcactgcggtttctttcaatggcatgatccggtttttcctcaatatatcacanatttgatcggggacttgcaacataaagtag

SEQ ID NO: 55957 - DNA, 101 bp, rice(Oryza sativa)
  misc_feature (71): n=a or g
aggaaatattatatccatgtcattggggagacaagcagtgtcaagttctataaaccctgctggggaacctnctttctcatttccatttgtcctataagagg

SEQ ID NO: 55958 - DNA, 101 bp, rice(Oryza sativa)
  misc_feature (71): n=t or g
aaaggtcagtggagtacaggctctttgtgactgtgatcagtagtgtgagtgagtgtgccattaggtcagtnatttgtgaatagttaacatgtagttgttca

SEQ ID NO: 55959 - DNA, 101 bp, rice(Oryza sativa)
  misc_feature (71): n=a or c
atggcaaattcagtaactgccactctgtcagcattacaacattattcaatgttgatgaaaatgtggcacgnatactttcaattctggatgtaatctttaga

SEQ ID NO: 55960 - DNA, 101 bp, rice(Oryza sativa)
  misc_feature (71): n=a or c
gctggaacatgagcggcgcctcgcgcttgaggttggaccagagctccagccggcggtcgatcctgtcctgnaggcccacgacgcagccgcagtccgccgtc

SEQ ID NO: 55961 - DNA, 101 bp, rice(Oryza sativa)
  misc_feature (71): n=t or c
taagacgtatccacatgaaacgactcatatcatctgccaacaacagaaagtacttcttgccgcccggcgtngccggcgtgattggcccgcacaagtcacca

SEQ ID NO: 55962 - DNA, 101 bp, rice(Oryza sativa)
  misc_feature (71): n=a or c
tttaggatacacgttcttgccaaatctgcgattcctttcactcttccacgaaatgccatccttgttcactntcaatgtctcgttgccatgaccacgagtga

SEQ ID NO: 55963 - DNA, 101 bp, rice(Oryza sativa)
  misc_feature (71): n=a or g
tgttcctcgtggggctccatctcggtcggtgtctcctcagacataccactgtcaaagaaaggtaaaattcnttgccgctttgaacaaaagctgggagctga

SEQ ID NO: 55964 - DNA, 101 bp, rice(Oryza sativa)
  misc_feature (71): n=t or g
aagaaaatattcgaagagttagcttcaagttttactcatcgcttcagatttagggatatgtggagccagcncgctcttctgcctccaaaactctctcgctg

SEQ ID NO: 55965 - DNA, 101 bp, rice(Oryza sativa)
  misc_feature (71): n=t or c
catgttctagatcgtggccaaaacatatacaggttcacaccgaacgatgcatttagcttcagatgtttagnttgatgtcattttaaatcatatcttttttt

SEQ ID NO: 55966 - DNA, 101 bp, rice(Oryza sativa)
  misc_feature (71): n=a or g
actttctgtccattgattgatattttttttgaacgactcaccgccatcgccaccagctgtgaacgctgtcnccggtcaccatcccgccagatccaggctca

SEQ ID NO: 55967 - DNA, 101 bp, rice(Oryza sativa)
  misc_feature (71): n=t or c
catgctaggtttatttttttcataaactaggacggagagagtaaattgacgtgtggtatccacgtgaaganggtctcaatctcacatgttatctgtccttt

SEQ ID NO: 55968 - DNA, 101 bp, rice(Oryza sativa)
  misc_feature (71): n=a or g
actttcacttaaagggtactttccatcctgcgacacacaagctcccaggatcaatctacttggccttgccnttctcgacagcagcagtcgaggggttcagc

SEQ ID NO: 55969 - DNA, 101 bp, rice(Oryza sativa)
  misc_feature (71): n=t or g
aatgcactgtaacctacaatatgatctatctacatgatcgaaacagaggcaaagcatctattgctacagtntatatctcagtatctcacatgtatacaaga

SEQ ID NO: 55970 - DNA, 101 bp, rice(Oryza sativa)
  misc_feature (71): n=a or g
tagtgagggtacattaggggtggctttggttgtagataccctaaacatagcgcattggaatttgtcaattngcaaaaagaaagatacacataatcttgctt

SEQ ID NO: 55971 - DNA, 101 bp, rice(Oryza sativa)
  misc_feature (71): n=t or c
agatttttatttttaaccgtacactcactcacatgtgtgggtcgcataggcttttctgattttgtcagcgncaagtaggtgccacatcagccgaaaccacc

SEQ ID NO: 55972 - DNA, 101 bp, rice(Oryza sativa)
  misc_feature (71): n=t or g
caagaatgtgccgaggtcataggtttttctttttggttgaatgttctctttgatgaggtttgaatctaagngctcttgtatctttttagttgtgtatatcc

SEQ ID NO: 55973 - DNA, 101 bp, rice(Oryza sativa)
  misc_feature (71): n=a or g
aaaacgccccaaatgaaataggtaccggttccacttaaaccggcacttatcagctgtcagggattctgtcngagtggctgctgccgctggatgacggcgct

SEQ ID NO: 55974 - DNA, 101 bp, rice(Oryza sativa)
  misc_feature (71): n=a or g
gccgcagctcccgatcttcaccgggagcaagatcgaggacgtgaacggcaacccactggagatcatcctcntcgacgtcgacaccggcgcgccggcgacga

SEQ ID NO: 55975 - DNA, 101 bp, rice(Oryza sativa)
  misc_feature (71): n=a or g
ggcatccaatgacttccgtggtgctgcattttgtttctccttctcagtatgaactgtagtcctttttgccntatctgttgacctgagcttgtcaaatttgt

SEQ ID NO: 55976 - DNA, 101 bp, rice(Oryza sativa)
  misc_feature (71): n=t or c
ctatcatagcaatggatagaatattactccctccctccgtttcatatttttaagttgctttgactgttttnatagtcaaatatttttaagtttactaaatc

SEQ ID NO: 55977 - DNA, 101 bp, rice(Oryza sativa)
  misc_feature (71): n=t or c
tcatttgaattctgaattcggtctgtctgcaatatgtttgctcatgatgcagaaactgtttcaaccaagangagtatgactggtgcatatgggttcgtaaa

SEQ ID NO: 55978 - DNA, 101 bp, rice(Oryza sativa)
  misc_feature (71): n=t or g
gtgcaagctcctcctgtatcgaattaagctagtgtccagcatcctctagtacatttaccttgccaaccacnaccagaaagtatatacatatcactgtacaa

SEQ ID NO: 55979 - DNA, 101 bp, rice(Oryza sativa)
  misc_feature (71): n=t or g
gtatccaagaagcaggaagaagcagctgatttgccggataaatgtgcagtaatctggtggtagttttggcnctctctctggtttgtctctgcttctgctgg

SEQ ID NO: 55980 - DNA, 101 bp, rice(Oryza sativa)
  misc_feature (71): n=a or g
ggttggctccgttttgtgtcgaatactttttagatggttactccctataagctccctaaccattgtatatnccctaacttgtcatcccactcagctgtccg

SEQ ID NO: 55981 - DNA, 101 bp, rice(Oryza sativa)
  misc_feature (71): n=t or c
tgggcctccaacaattccagcaggaagcagctcaaatgagccaccatagttctgtttgacaagaatgaaanaaatatattttcatcacacacggttgcaaa

SEQ ID NO: 55982 - DNA, 101 bp, rice(Oryza sativa)
  misc_feature (71): n=a or c
cccccgcgcgccgccgatcgaatccgcaagccgcgatggattcccttcttgccaactacgcctcttccgangacgaggccgacgaaaccctacccactcct

SEQ ID NO: 55983 - DNA, 101 bp, rice(Oryza sativa)
  misc_feature (71): n=a or g
agcccacagatgttcagaagaatgtttaattgagcctcggaggtagatcgattggaccacagcttgtgccnttcgtgtgcctcctcgctttcgagcatata

SEQ ID NO: 55984 - DNA, 101 bp, rice(Oryza sativa)
  misc_feature (71): n=t or c
gtgactcagtgagcattgaccacgcgttaaatattacagacctgtaggttctagaaacattttcgcaaagntaaaagggcgcacgcagcatgccagtttta

SEQ ID NO: 55985 - DNA, 101 bp, rice(Oryza sativa)
  misc_feature (71): n=t or c
tcctctatccaacctttcttcccccttcctctctctccttatctcatcctttctcttcctcttcggccaanggcgaacaccggtgcggcaacatggcggtg

SEQ ID NO: 55986 - DNA, 101 bp, rice(Oryza sativa)
  misc_feature (71): n=t or c
ctcctttttgtcagccggatttccccatcacaataaaaccggatttttcgctgatatcctattgtgctgtngtttcagggatggccagattgaggcccgca

SEQ ID NO: 55987 - DNA, 101 bp, rice(Oryza sativa)
  misc_feature (71): n=a or c
taatatcaatatcaacgttaaattcatattcaactagaactactagcctcttggtcaggctcatgcaccanacgatatagaagagctttcagtggggatcg

SEQ ID NO: 55988 - DNA, 101 bp, rice(Oryza sativa)
  misc_feature (71): n=t or c
gtttcttgtcaaaagatcgtatgcagaaatcaagccggcatagcatgcagctggaattccgggcaaaaggnagatgcagctagcttttgatgatgcatgaa

SEQ ID NO: 55989 - DNA, 101 bp, rice(Oryza sativa)
  misc_feature (71): n=a or g
tttcttttatccgttgaaaagtgtgctctcgttggtaatgagtttattgatggcacctgataatatgctgnttttatttgttgggatggtaatccaagcta

SEQ ID NO: 55990 - DNA, 101 bp, rice(Oryza sativa)
  misc_feature (71): n=t or c
tgggcggtttgggagagtcaaggtgtaggaatatatgatgtaatgagaagttgtttgagatgatgtggaangacgataaactagtaagagatgttcaaaac

SEQ ID NO: 55991 - DNA, 101 bp, rice(Oryza sativa)
  misc_feature (71): n=a or g
catacccaaccttaggctggcctgaattcgagagcgagccttgcctactaacacggaaaaccaaacaaagnattagtacataattaattttaattaagtat

SEQ ID NO: 55992 - DNA, 101 bp, rice(Oryza sativa)
  misc_feature (71): n=a or g
tgatgtattatataagattcttactggtggctgcacctcttcacataaagccaatcagattttgtgccacnacaagctttttaatatggtttccgagaact

SEQ ID NO: 55993 - DNA, 101 bp, rice(Oryza sativa)
  misc_feature (71): n=t or c
gctgtgtctagttactggattaagcgcagtgcactgcagagagccagagattaggccttaaaaaaagaatnagctgcagattacgaatcaattgatcagac

SEQ ID NO: 55994 - DNA, 101 bp, rice(Oryza sativa)
  misc_feature (71): n=a or g
cagttagccatcgtcggtcgacgaccaatcagatcaatcagttaactaattatggatcaggagaaggcggncggcggcggcaggaggaggaggagcagggc

SEQ ID NO: 55995 - DNA, 101 bp, rice(Oryza sativa)
  misc_feature (71): n=a or g
ccgcatcaatcccccatccatccccagccatttcgaaagcaaattgcatcatccaattcacatccatggtngaggagagagaaagcttcgagagccaatgg

SEQ ID NO: 55996 - DNA, 101 bp, rice(Oryza sativa)
  misc_feature (71): n=a or g
gcgctagggtttatgcgagtaagaagatagaacgacgcggccgtaccgttggaacgtagcaggggttgccnccgaagcaggatcagcagacgctgggtaca

SEQ ID NO: 55997 - DNA, 101 bp, rice(Oryza sativa)
  misc_feature (71): n=t or c
cgctattcagaaaggtcatatgttagtgatcacgttaaaagaaaaagtaaataatacttcctccgtttcanaatgtaagtcattctagcatttctctcaca

SEQ ID NO: 55998 - DNA, 101 bp, rice(Oryza sativa)
  misc_feature (71): n=a or g
cattgcagccgtactgccttccctcagcgtttactcatcacgtccactatcaaagcatgatctaaattcancgtgtcttaaaaacaacggaaagtagcaaa

SEQ ID NO: 55999 - DNA, 101 bp, rice(Oryza sativa)
  misc_feature (71): n=t or g
caagctggagaagattgtgtggaacttgaacaagacgaagacgttggtgacgatctcccccgacgacattnctgggatcaataacacggccatacttcgct

SEQ ID NO: 56000 - DNA, 101 bp, rice(Oryza sativa)
  misc_feature (71): n=a or c
aatttatttttgagtccaaaatagaaatgtaaatgaaagtaaagcctaaacataacatttctggttgattntaaactaaaatataatttttctaccattta

SEQ ID NO: 56001 - DNA, 101 bp, rice(Oryza sativa)
  misc_feature (71): n=t or c
cgtcgtcgcggcgccctcggttctcttcacagccttatctttcatcaggttggatccaggagcgcgagaangaggcgcgatcggggaaggcgaggacaaca

SEQ ID NO: 56002 - DNA, 101 bp, rice(Oryza sativa)
  misc_feature (71): n=t or c
gcactcgagcagtcggagctgacacttttaggtcctggttggcacagctccaagcactagctctatctctnctggagctggagctcagccaaacagtttca

SEQ ID NO: 56003 - DNA, 101 bp, rice(Oryza sativa)
  misc_feature (71): n=t or c
tggcggcttgaaggacgatcagaccagccgatctacatcggttagaatgatggttaaggtgctgtcagacnggcgtgagctctgtggccagacccaacttc

SEQ ID NO: 56004 - DNA, 101 bp, rice(Oryza sativa)
  misc_feature (71): n=t or c
tagataaccagggttatgcaatatacttctcaagagggctgattccatttaataagtgagatactacctcngttttttaatagatgatgctattaaatcga

SEQ ID NO: 56005 - DNA, 101 bp, rice(Oryza sativa)
  misc_feature (71): n=t or c
ttcggttccggccgcacattcacccaggtgtgcacatctcggcaagcagaaccctcgatgccgcctagatntggtgccgacagtgacaacatcggcattgg

SEQ ID NO: 56006 - DNA, 101 bp, rice(Oryza sativa)
  misc_feature (71): n=t or c
tacacaactaagtagatgatctacactgaaacctgttaagtagttctacaccgaagcattatttttacctngcaatatttgtatataaataaaatagccat

SEQ ID NO: 56007 - DNA, 101 bp, rice(Oryza sativa)
  misc_feature (71): n=t or c
tcatcactattatatcgaagaaatgcccggtgaaaaatacactactactattgatataacctactccctcngtcaaaaaaaaaaaacaaaccatggtttct

SEQ ID NO: 56008 - DNA, 101 bp, rice(Oryza sativa)
  misc_feature (71): n=a or g
tttatattattttgtaaaacttggtaacattgacttcgggaaagtccatgtcctcacccaataattccacnaaggcaccaaacagtagacagtttgctgtc

SEQ ID NO: 56009 - DNA, 101 bp, rice(Oryza sativa)
  misc_feature (71): n=t or c
ttgaaccaagatatcacaaaacttaaatttagcacaacggatcttgctatgggcttatttggcacagctcnagctccagctccacctctcctggaactgga

SEQ ID NO: 56010 - DNA, 101 bp, rice(Oryza sativa)
  misc_feature (71): n=t or c
ctagcacttgttgaatttccactggaatttgctccttgtctgaagattctgatagtgtgcacaactgaatnaggtgagagatggcctgtctatccttcaac

SEQ ID NO: 56011 - DNA, 101 bp, rice(Oryza sativa)
  misc_feature (71): n=a or g
ttcgatcaggacaccagacatgagaagtgacacaaatgtgagaagaaatttagagggaaacatatactatntacataagtttttcatgcacaccaactaac

SEQ ID NO: 56012 - DNA, 101 bp, rice(Oryza sativa)
  misc_feature (71): n=t or c
tccactgctaaaacatgggttctagttagggaacttcacctctcctcctagcagagcacaatctgattgcnggcatccatcgacaatccccttgataacct

SEQ ID NO: 56013 - DNA, 101 bp, rice(Oryza sativa)
  misc_feature (71): n=t or c
atgtcctgctctttcacaacctgtactttcacgtctagatgcgagaggcaaccaagagttgatgagttaanccacacaggtaggctaaaaaacttgatgca

SEQ ID NO: 56014 - DNA, 101 bp, rice(Oryza sativa)
  misc_feature (71): n=a or g
acctgcaatccgcatgtcccacacccgacagatctagacgaaaccctccaacgggaaaaatggccacacancctcccctagttccatcagaagaatcaggg

SEQ ID NO: 56015 - DNA, 101 bp, rice(Oryza sativa)
  misc_feature (71): n=a or g
agaactaatcccaggcagcgccggtgctcatcttcattaatttgtttcatcttgttggcgataccgtagangaaatgaagatgagtatactgtcctgctgt

SEQ ID NO: 56016 - DNA, 101 bp, rice(Oryza sativa)
  misc_feature (71): n=a or g
ggcggcggcggttgcgctcgacggcaatgtgggtcatccgctggcactcgatctcctccttgttcttgacnaccttcgtccgcctccgtttcctcctcccg

SEQ ID NO: 56017 - DNA, 101 bp, rice(Oryza sativa)
  misc_feature (71): n=a or g
cttaaatttctgactagcatattgagaaactggtaactctaccagttctgggcaatctctaattatgaaantttctaaaagggaaaacaggagaaatttgt

SEQ ID NO: 56018 - DNA, 101 bp, rice(Oryza sativa)
  misc_feature (71): n=a or g
tttcttttgaaaacttcacctaaaggtccatcatcaagtgtttccttagagactgttaaccgactttcgtncatcatactgcctttttctgatgaactgcc

SEQ ID NO: 56019 - DNA, 101 bp, rice(Oryza sativa)
  misc_feature (71): n=t or c
aacatttattggagcctcgaagaaaaaagcggtactaagagcacctgcaatgtgtgaattaacaagggtantaagagaatcttttcactgtagcacacgct

SEQ ID NO: 56020 - DNA, 101 bp, rice(Oryza sativa)
  misc_feature (71): n=t or c
ttaggagcagagacgagagtacatgtgttgtgtaccatgtgtctgtgagtgtaatttcaatttccttgtgnatttcgcaacttttcagcttatgaatcctg

SEQ ID NO: 56021 - DNA, 101 bp, rice(Oryza sativa)
  misc_feature (71): n=a or g
gagccccctcacggatccctctccccagccatcactgccaattgacgatccttaagtaccgaattcaaccntcaaaacctgcataaaagcaaatgaaataa

SEQ ID NO: 56022 - DNA, 101 bp, rice(Oryza sativa)
  misc_feature (71): n=t or c
tccttgcaggtggtgcaactatctttcaatgatcaaaccatgggatatcaccattacccaactagctgttnagatgaaagaatttgtgggataataagggt

SEQ ID NO: 56023 - DNA, 101 bp, rice(Oryza sativa)
  misc_feature (71): n=t or c
cacctagaagagaagcccaatgcagcgcgcataccgtcggacgctgtccaactcggcctctgtgcccaacngacaatggtgccggaaacggctgtgtcctc

SEQ ID NO: 56024 - DNA, 101 bp, rice(Oryza sativa)
  misc_feature (71): n=a or c
accaacaaacgcattctataagggatcaatctccttcccctatgtcgtgtttctttgacgcaacactggtnctgtgaagggcaaacttttcctttggcttg

SEQ ID NO: 56025 - DNA, 101 bp, rice(Oryza sativa)
  misc_feature (71): n=a or g
tagacccatacccatgtacctaataggtaagaattttcgcccgtcggtaaactcatgggtataagagttanaacataattagcatataatagataattagc

SEQ ID NO: 56026 - DNA, 101 bp, rice(Oryza sativa)
  misc_feature (71): n=t or c
ttctgcaatttgcatattccttttactatatttcgagtgttcagatatttaccccattcaagactatatanctttaattgtacgttttgtatcatacgtcc

SEQ ID NO: 56027 - DNA, 101 bp, rice(Oryza sativa)
  misc_feature (71): n=a or c
gactgaacaatttttgacaataacttggaattttcttgggctagtttcaccaactcaaaatcgcttttggnaatctgtataaagaaaataatgaggcgttt

SEQ ID NO: 56028 - DNA, 101 bp, rice(Oryza sativa)
  misc_feature (71): n=t or c
taacctattattaaaatatcaattttagaaacaaacgaatataagttcctctcgtagttcattgcatttgnaaaataggtttagaaaagatgtactctatt

SEQ ID NO: 56029 - DNA, 101 bp, rice(Oryza sativa)
  misc_feature (71): n=t or c
tattttaaaaaaggaaagaaaaaatgtctgctggtagctatatatacgcgtacgcgcgggcactgactacntcatcaaccaatctgccctccagtgtgtgt

SEQ ID NO: 56030 - DNA, 101 bp, rice(Oryza sativa)
  misc_feature (71): n=t or c
taaaccctttctttacaacagattcgaagaaggtgctgaactcatagatgtttgctggatggaaatccgtngcaacatagatagcaaaatgctctccccaa

SEQ ID NO: 56031 - DNA, 101 bp, rice(Oryza sativa)
  misc_feature (71): n=t or c
tgcaatttgcaaggcaccggcatgctgcaccaaaggtttgtctagcgccaccaattcaaaccaaagccagngcagagcttagtgctcgagcaaaacgttga

SEQ ID NO: 56032 - DNA, 101 bp, rice(Oryza sativa)
  misc_feature (71): n=a or g
cggttttgagcggtgcacgcaggagcaggctgtgtatactcggggcacaggcagtggtggtgtcatcgttngcgtctatgtcgatgatctgattgtgactg

SEQ ID NO: 56033 - DNA, 101 bp, rice(Oryza sativa)
  misc_feature (71): n=a or g
gtcgtggtcttctcctcatcccacatgtttaccggagaagagaaagaaaccagagaggggtattttggtcngttgaagtgcaaaaaaggtgaaaatcttat

SEQ ID NO: 56034 - DNA, 101 bp, rice(Oryza sativa)
  misc_feature (71): n=t or c
ggcgatagtcagattttaagtgaatgtggtctatcagatgaccatatacttcatgttttggtttctccagncgacaaaatgtgtgtctatataaacattag

SEQ ID NO: 56035 - DNA, 101 bp, rice(Oryza sativa)
  misc_feature (71): n=t or c
ttaatagaactattcttccttccagtaccctacattttacgaagataaagtgagtatgtaacgttggtgangctttaagattagaatgagatgcttgattt

SEQ ID NO: 56036 - DNA, 101 bp, rice(Oryza sativa)
  misc_feature (71): n=t or g
tgattcgggagactcaaaaggaataatagttgttacttcctttgcatattcgtcttcaggcagggaatcantcaaggcaaatcttgattgtgaaaatgaaa

SEQ ID NO: 56037 - DNA, 101 bp, rice(Oryza sativa)
  misc_feature (71): n=t or c
aagaaaacctgagcgcaacaatcgctacccgccaggcatttgctgagccgcatccaagcaatcaacgtggncgagctgcgttgccgtcatcacagggactc

SEQ ID NO: 56038 - DNA, 101 bp, rice(Oryza sativa)
  misc_feature (71): n=t or c
cacctataaaacacataggtgccaaacaggtgccggtttgggaaccagcaccaatgtaaaatcattagtgncgactaattggtgccagcaccgaaaccggc

SEQ ID NO: 56039 - DNA, 101 bp, rice(Oryza sativa)
  misc_feature (71): n=a or c
agaccgaacttaaggtctcatccaaataaattgtttgccatcaagggagcaccaattgtgcggtgagagcngtctcaacccataacactagacatggtttc

SEQ ID NO: 56040 - DNA, 101 bp, rice(Oryza sativa)
  misc_feature (71): n=a or g
ctttcctcgcactgggttactcaaattttaaactcccgtcgtcgataactaataacgtacacattcatttncagtccgatcaaatcattgtataaaaaaaa

SEQ ID NO: 56041 - DNA, 101 bp, rice(Oryza sativa)
  misc_feature (71): n=t or c
gatcgacgcgcatgcagcggtccatgaggttgatggtgtagaagcatatagcttggtgaagagcgccaggntaagccacctgccctgcgagggtagatcag

SEQ ID NO: 56042 - DNA, 101 bp, rice(Oryza sativa)
  misc_feature (71): n=t or g
tggttaaagatgacaagattgccatctgatgagaatttgagctgtgttagattgagctcagggatagtgantggcctctccctgttggcaacccatacagt

SEQ ID NO: 56043 - DNA, 101 bp, rice(Oryza sativa)
  misc_feature (71): n=t or c
cgacagagaagtaaaaaacgggtgagatgtgtactacagtaaagaaacatccatccatctggacccggctncgacaaggaatccaaaccgttagcgggaag

SEQ ID NO: 56044 - DNA, 101 bp, rice(Oryza sativa)
  misc_feature (71): n=a or g
ctgtgatgaaattgttattgttgtgataagtagattagtgtatcgaaagggtgcagaccttcttgtggaanttattccagaagtatgccgtctttttccta

SEQ ID NO: 56045 - DNA, 101 bp, rice(Oryza sativa)
  misc_feature (71): n=t or g
aactccttctgtgtactggcatcattatatctttcaaggcaataacattttcatggcgcaagtgtcgcagnagtttcagctcccttagggtcctcagtgca

SEQ ID NO: 56046 - DNA, 101 bp, rice(Oryza sativa)
  misc_feature (71): n=t or c
gagaattggcacttttgttttttatgaaagccaccctgttttcaaagtgatggcccctcctagttccctanttgagcctactacttattatgctggaataa

SEQ ID NO: 56047 - DNA, 101 bp, rice(Oryza sativa)
  misc_feature (71): n=t or c
acaaatgcaaactcaattaattcatagatatatttcaatctaggccgtgtttagtttccccctatattccnaactttccatcacatcatatcacatcaaaa

SEQ ID NO: 56048 - DNA, 101 bp, rice(Oryza sativa)
  misc_feature (71): n=a or g
gccatgcaccgaagttcatctgatagatcattgcctgccgagtctccttttgcaaccaagaggttgctgcntacccaatcctctctcagtgcatcacatgg

SEQ ID NO: 56049 - DNA, 101 bp, rice(Oryza sativa)
  misc_feature (71): n=a or g
atgtcctactagtggacaaccgaaagcggaagagaattttggagggaggaaagtatatacacactgacatntgggaccgattgttagattgaagagtgtaa

SEQ ID NO: 56050 - DNA, 101 bp, rice(Oryza sativa)
  misc_feature (71): n=t or c
tggaaccccatccccactagcaacattactggcccggtccgctgagacttcggcggcatccccggtgtccnggcccactgcgggtccacccggcgtgactt

SEQ ID NO: 56051 - DNA, 101 bp, rice(Oryza sativa)
  misc_feature (71): n=a or c
gcaaactagagaggacaaagatgatcttatcataagatgaaggtagtacatgtcaacaaatatttttaatntcttctttctataaagctaatgcccactaa

SEQ ID NO: 56052 - DNA, 101 bp, rice(Oryza sativa)
  misc_feature (71): n=t or c
aaaatcaatataggtgcaacgtacgaacgtacaatgcgatgcacaggcccatcgatcgataattgatcatnaacttggttaattacagctcgtgtgttcca

SEQ ID NO: 56053 - DNA, 101 bp, rice(Oryza sativa)
  misc_feature (71): n=t or c
aggagaaaacaagaagatggtatgcatgacccaagcaaagcaaaagcaatactgaggtggtgtttagatcnagggacttaactttagtccctgtctttaga

SEQ ID NO: 56054 - DNA, 101 bp, rice(Oryza sativa)
  misc_feature (71): n=a or g
gagcttcctcaagtttggcctcactgatttgacatgaccaacacaaccaaacaccctcaggtgttcgaccnatggacaccgtccatgccaggcttcatagg

SEQ ID NO: 56055 - DNA, 101 bp, rice(Oryza sativa)
  misc_feature (71): n=a or g
gccggactcactagggttcggccgaacctcatggttcggccccggatttgaatggtagtctcccccgctcntcctgagtctgtttagatgcgagttcagag

SEQ ID NO: 56056 - DNA, 101 bp, rice(Oryza sativa)
  misc_feature (71): n=a or g
taatctggagcaactcatgtcactccatgaactgaagatgtatttttgcttgaacattcagtcgcttccanagctgccccgatctcttgaggagtttggat

SEQ ID NO: 56057 - DNA, 101 bp, rice(Oryza sativa)
  misc_feature (71): n=a or g
atcaaatcgcatctactttttcttgaaacataaacttggatatgtctaatctacggatcggactatcctcntattttttataatcaaaacatatgttttta

SEQ ID NO: 56058 - DNA, 101 bp, rice(Oryza sativa)
  misc_feature (71): n=t or c
acaaatattgtattatcctaggcggatgtcttaaagctacacctgtgaagttatattttcgtagacggcancttatgctgtctgctctatataattcacac

SEQ ID NO: 56059 - DNA, 101 bp, rice(Oryza sativa)
  misc_feature (71): n=a or c
gcagatactggaccgagtgtcatgttgggccaaatcttatttcagcccaaatttcggcccaagagagttcnacggcccacgagatccacaactcccggcgc

SEQ ID NO: 56060 - DNA, 101 bp, rice(Oryza sativa)
  misc_feature (71): n=a or g
tacggttaaaaactaggggtgcaagcgatagaccatgaacccgtttatagtacaaatagacaggtttacangtctgtccgcttacacccttaccaaaacta

SEQ ID NO: 56061 - DNA, 101 bp, rice(Oryza sativa)
  misc_feature (71): n=a or g
ggaagcaaagcaaagcaaagcaggcgaggtttcagtctcccaggaatccccttccaagaactcccacccgnttcgaagcgctcgaggaggttctttgctca

SEQ ID NO: 56062 - DNA, 101 bp, rice(Oryza sativa)
  misc_feature (71): n=a or g
gaatagtgtaagattgttattgggaaacttatagtcatagtcgatcggtcatactcacaaaaacgagcacncacacacacaagcaaatagcacctgatgaa

SEQ ID NO: 56063 - DNA, 101 bp, rice(Oryza sativa)
  misc_feature (71): n=a or g
agcgattcaggctgcaaacatgatggacattgatactgggccaggttgggacaacaatcagaatcagaagngcattgttcccaaagagagggcaccggtgc

SEQ ID NO: 56064 - DNA, 101 bp, rice(Oryza sativa)
  misc_feature (71): n=a or g
ctctcgtgcactaggattaatcttagcgccatcccgttggccgttcgtaaaagtagaaaaacccacccggntcgatcgatattcccggcgtttccgtcctc

SEQ ID NO: 56065 - DNA, 101 bp, rice(Oryza sativa)
  misc_feature (71): n=a or g
ggttgccatcaggaaacatgaaaatgcgcatcctaatcgatatgacgacaagccggaaatgcatcgtttgnttcatctctgctcaatgcttgaacacaaaa

SEQ ID NO: 56066 - DNA, 101 bp, rice(Oryza sativa)
  misc_feature (71): n=a or g
aaagaaattcttattaagtctgtccttcaggctattccagtttatgtcatgggcatcttcaagatcccggnctcggtttgtgatgaactaacaaaagccgt

SEQ ID NO: 56067 - DNA, 101 bp, rice(Oryza sativa)
  misc_feature (71): n=a or g
catattcttagaattatgtggtttttatcttttaccttcagcacagcacagtcaaagtggttcataagganacaacaggcagaaataaagaagaattcaaa

SEQ ID NO: 56068 - DNA, 101 bp, rice(Oryza sativa)
  misc_feature (71): n=t or c
attcattgtactagacaatgttcttttcgacttccaatagcttattggaaggagtcacttccttgtttacngtgaacatacttcatagattattgaacgga

SEQ ID NO: 56069 - DNA, 101 bp, rice(Oryza sativa)
  misc_feature (71): n=a or c
ctttgcacttccttctgtaacttgtttatgtgatctcataattcctctgtgatctcagaatcggacaatgncagcgttgttactgatttaaacgcaacaag

SEQ ID NO: 56070 - DNA, 101 bp, rice(Oryza sativa)
  misc_feature (71): n=a or g
gcaggcagctggctctgctttcgtcaggtaccacttaaaagataatatatattttcatttaattaatctancaagacaggatggggtggtggcgcagttgg

SEQ ID NO: 56071 - DNA, 101 bp, rice(Oryza sativa)
  misc_feature (71): n=t or c
gaagaaaaggcgcgtgtccacaaaatgctgattatacaacaagttagtactcctatccagggtttaccttncagtttccaaagtgaaaaccgctcccttcc

SEQ ID NO: 56072 - DNA, 101 bp, rice(Oryza sativa)
  misc_feature (71): n=a or g
attccgatttgaattacacgcaaaatcaccccgaggctgatctgaccgccagtgtccctatggtctaactngacctggcagccggtctgaccgactggtca

SEQ ID NO: 56073 - DNA, 101 bp, rice(Oryza sativa)
  misc_feature (71): n=t or g
agaatctcgaccgatcaaggaaaaatgttcttttctgaacttgtcttctctgcatcctttccttgccgccngccaatttattgactcaccgagaagtttga

SEQ ID NO: 56074 - DNA, 101 bp, rice(Oryza sativa)
  misc_feature (71): n=a or g
gtcatataccaacattatctaaagttccaaacacatgtaacgctgaaacatcttagttcagagcaccctangagtttggtgatttaattaggtacgttctt

SEQ ID NO: 56075 - DNA, 101 bp, rice(Oryza sativa)
  misc_feature (71): n=t or g
caacagccctgggcaatgtctgtagccctgcctcaggatcatgaggagaatgacgacgaaggatcacaaanatcaccgcctgcgaagcgactgcggaactc

SEQ ID NO: 56076 - DNA, 101 bp, rice(Oryza sativa)
  misc_feature (71): n=t or c
atcccatccagtactaagctcatgaataacctgatgggcctttacctggagctaggccaacatagcaaggnggctaacctgtttgatgagatgaaagagag

SEQ ID NO: 56077 - DNA, 101 bp, rice(Oryza sativa)
  misc_feature (71): n=t or c
aagtcacatccttcaaagtgcaagttcgttgtagtgggcctcaccattatcttctttttttcaatctttcnttcccctctctctcctcgtagttcttcttt

SEQ ID NO: 56078 - DNA, 101 bp, rice(Oryza sativa)
  misc_feature (71): n=a or g
caacataatatcacttcgatctttccacagtatcgtgccatgcattttctctcacaaatgtcgtttacaancttttatgttgccttttgcttgctcaatac

SEQ ID NO: 56079 - DNA, 101 bp, rice(Oryza sativa)
  misc_feature (71): n=t or c
aacccaataattttgaacgaacggctagagaggatacacacttacgtgtgttctgttgtaatgtgcgtttnccgcacaccgaaggctttaggtccttcaag

SEQ ID NO: 56080 - DNA, 101 bp, rice(Oryza sativa)
  misc_feature (71): n=t or c
tatcgagcaggtgctgtggctcagatctacggtggattttctgaagttgacatccctattgggtgctatantggtcagacatctgaagtaagtgttgtttc

SEQ ID NO: 56081 - DNA, 101 bp, rice(Oryza sativa)
  misc_feature (71): n=a or g
ttcttcttggagatgtgggcacgggcaagtcgagcctcgttctccggtttgtgaagggccagtttgttganttccaggtgaatttcttttacacgtgaact

SEQ ID NO: 56082 - DNA, 101 bp, rice(Oryza sativa)
  misc_feature (71): n=a or g
tgttagaaactttgtttcagaaagctcagaaaattagaaaatgctgcgatgaaacaattaatgtgctcaantttttgagatggaaaccggcgctcaaaaac

SEQ ID NO: 56083 - DNA, 101 bp, rice(Oryza sativa)
  misc_feature (71): n=t or c
gtggttttggtctacgtggcgtacacgtggcagtccagtcactaatagtagcaaccttccccttccccttngaaacaaagtagcatgtgatttccctacac

SEQ ID NO: 56084 - DNA, 101 bp, rice(Oryza sativa)
  misc_feature (71): n=t or g
atgaattacatcgtgaaacggggggagtagaaaagatataagtggagcaatatgaagcaagatgtactttntttgtcttacagattacttgtatctgtaat

SEQ ID NO: 56085 - DNA, 101 bp, rice(Oryza sativa)
  misc_feature (71): n=t or g
agcagtagtataactaagcaggaggaaggaagcacacggattaggcgagtagctgacctcacctcacctgngattgctgtagtgcatcgcagccagcccag

SEQ ID NO: 56086 - DNA, 101 bp, rice(Oryza sativa)
  misc_feature (71): n=t or c
acgtttgtcgatatggacggtatgccgcccaagatctgcatttgataggctgattttgctgtgtaagatcngcttggtgtccatttccatcgaatgatgtc

SEQ ID NO: 56087 - DNA, 101 bp, rice(Oryza sativa)
  misc_feature (71): n=t or g
ccatgctaccacctttacttgtatctggccttacaaaggtagccgcctgccatgctaatgaggatattatntctgaccatacatccacaggatcaacgcca

SEQ ID NO: 56088 - DNA, 101 bp, rice(Oryza sativa)
  misc_feature (71): n=a or g
gcgtcttccacagaagttgaaataacagcaccacgtccatcagaaacagcaagacgaccaaactccagacnaggagtaccagtagaattttcatcatcaat

SEQ ID NO: 56089 - DNA, 101 bp, rice(Oryza sativa)
  misc_feature (71): n=a or c
aacaaatcagctcctgtgttgagccgatgacccaacaaaatgtacttacttatgaatatcgatatcaagangacaaaatgaaataaaattctggcctttca

SEQ ID NO: 56090 - DNA, 101 bp, rice(Oryza sativa)
  misc_feature (71): n=t or c
aaaaattccactcttcctattggcggcattcttctgccttggagtacaatttgcagtactgatatactagnagtacaaatttctgtgtaattttcactagt

SEQ ID NO: 56091 - DNA, 101 bp, rice(Oryza sativa)
  misc_feature (71): n=t or c
gtactctgagccgtcgacgaagacgatctggccagtagtgaaccactggtcaaccatttcctggacagttngcatgtgatgaccccgtgcacgagcgacga

SEQ ID NO: 56092 - DNA, 101 bp, rice(Oryza sativa)
  misc_feature (71): n=a or g
gttggaaacccaccacccgtgtgcactatatatgggtatgggtatgggaaaattttgtacccgaccgcagntgtgggtgttgtaatgggcatatttaattt

SEQ ID NO: 56093 - DNA, 101 bp, rice(Oryza sativa)
  misc_feature (71): n=a or c
tagtctcatctcactactagaggagcttgcttaattaatcattagcataattaagcagcagccatcgatcnctcaaaaaccaaaaggattaattaattaat

SEQ ID NO: 56094 - DNA, 101 bp, rice(Oryza sativa)
  misc_feature (71): n=t or c
gtccattgtagatctaacaaacatatagagctcatacaaggtcctccagggtctgggaaaacagaaattanaattgctttgcttcaagtcttgcatcacat

SEQ ID NO: 56095 - DNA, 101 bp, rice(Oryza sativa)
  misc_feature (71): n=a or g
ggagcttgttctgacccaccctgaattcaatccctaggatgacatagtgtgtctcatttgtttagaatatncacatgcatgtgtgttcaacggacaagttg

SEQ ID NO: 56096 - DNA, 101 bp, rice(Oryza sativa)
  misc_feature (71): n=a or g
gccttcgactcggtctcatgggagtacctcctaacgctgcttgaaaaaatggggttcagtactagatggcnagactgggtggctttaatcctctcaacctc

SEQ ID NO: 56097 - DNA, 101 bp, rice(Oryza sativa)
  misc_feature (71): n=t or g
taccaaggtaagagttttcagccttgaaaattcacatgtgcattgtttcaggttcatatatctgacccaantagtgcccttgccaaattcagttccagaac

SEQ ID NO: 56098 - DNA, 101 bp, rice(Oryza sativa)
  misc_feature (71): n=a or g
catattttccctgcgcgatgagttctgcgcatccattcatcttttccaactcccagctcatgttagtgttnagaataagacatattttcatgtgtaaaata

SEQ ID NO: 56099 - DNA, 101 bp, rice(Oryza sativa)
  misc_feature (71): n=t or g
cagagaagatgaagagttgaatcatcaagattatagaagaccaagagtcgtgacccttccggaaacatcangtggctttacactttttcattttactccaa

SEQ ID NO: 56100 - DNA, 101 bp, rice(Oryza sativa)
  misc_feature (71): n=t or g
gcacgagtttctgtcccgaatggatatccgcaatcgcaacaacaagatatatgaaatctgggtggaggatntgagaatgttagcacatcagatcgaggaca

SEQ ID NO: 56101 - DNA, 101 bp, rice(Oryza sativa)
  misc_feature (71): n=t or g
ctcagtaaaaaaaaaacagaacggtaaaacgtttgatttttgttggtatacctatcaccctactgcatccnccgttccaattttagtgaaaccataagttt

SEQ ID NO: 56102 - DNA, 101 bp, rice(Oryza sativa)
  misc_feature (71): n=a or c
ttctagtttttttctcagttactcatctatacttgcacaaatatatgaaattgcaagttcagtataaggcnttgcaagctcaggttattgcatttgctgca

SEQ ID NO: 56103 - DNA, 101 bp, rice(Oryza sativa)
  misc_feature (71): n=t or c
acatcctcctcctcatctgcccttaggtcaagcccctccagcataacttcgatttcctccttttccttccnccgatccgccgcaggcaccttgctgcccgt

SEQ ID NO: 56104 - DNA, 101 bp, rice(Oryza sativa)
  misc_feature (71): n=t or c
accagcctctacttgaacgacaacatgctcgagggatccatacccctctcggtgttcaacctcctctctgnagcattgtcacgccagagcattcatcatca

SEQ ID NO: 56105 - DNA, 101 bp, rice(Oryza sativa)
  misc_feature (71): n=t or c
tctcttggttctagttaattcttatttgatcttagtaataaaagaaatatgttcgagggagtattatggcngtgattgaaacaagtaatggctgattagca

SEQ ID NO: 56106 - DNA, 101 bp, rice(Oryza sativa)
  misc_feature (71): n=a or g
aaggagtcgggtttacgggccttgggctcgcactggtgacggcggtcatgcatgtcttcatcatgttctcncagtcagagcgatcgagctcagccaaggcg

SEQ ID NO: 56107 - DNA, 101 bp, rice(Oryza sativa)
  misc_feature (71): n=a or g
atcatcatcttcgcaggaagtgtcgggtacaaatctgaatggaatacttcgctcctgcaagaacatggtgncttgtgacatgactggcagctcctgctttt

SEQ ID NO: 56108 - DNA, 101 bp, rice(Oryza sativa)
  misc_feature (71): n=t or g
tatctcagagcagtaaaacaggctaaatagatggagaaaccaacaatccagtagctccctgtattttcatntatatatcatacttgatgtaatttgcagta

SEQ ID NO: 56109 - DNA, 101 bp, rice(Oryza sativa)
  misc_feature (71): n=t or c
atgacatgaaagttatagtcgttactacatctcgtagtaatgacatgatgtaattgcagtaactacatctngttgatgccttccggccaacaggcgaggtt

SEQ ID NO: 56110 - DNA, 101 bp, rice(Oryza sativa)
  misc_feature (71): n=a or g
atctgcactataaagttgaggaatgtaggaattctccatcggcacgagtggcctaatcaagtgcctacgcnaccgtctgctcctaagagcacctcgacctc

SEQ ID NO: 56111 - DNA, 101 bp, rice(Oryza sativa)
  misc_feature (71): n=t or c
aagggttccccatgcatgaagaccttcacaaaccttgatggtgacaatcctgcaggcttcacctctggccnagcagaagcattcctatccttcatcctacc

SEQ ID NO: 56112 - DNA, 101 bp, rice(Oryza sativa)
  misc_feature (71): n=t or c
ggagaccgacacacgtgcacactccacatcacccaaaaaccagatctacactccacaccacccaaaaaccngcgggagtgcgaggagccgtgggcagaaag

SEQ ID NO: 56113 - DNA, 101 bp, rice(Oryza sativa)
  misc_feature (71): n=t or c
gacatgcgtgctatctataaatttggtttctactttatcttcctttgtttctatttcttgcattgttactngattttttatctctttcttcatacaatcaa

SEQ ID NO: 56114 - DNA, 101 bp, rice(Oryza sativa)
  misc_feature (71): n=a or c
ctgttacatatgctcccttacttagcattggcatgtatgaaggagagagaacacgagattatttgcatgtncataacaccttttagcaaacttgaaaatga

SEQ ID NO: 56115 - DNA, 101 bp, rice(Oryza sativa)
  misc_feature (71): n=a or c
tgggatgtatcgagtcagttactgacataaaacgtactaagggtatccacaatgtgttgtaaaagtagtcnataagcaatagaatattccattcagccacc

SEQ ID NO: 56116 - DNA, 101 bp, rice(Oryza sativa)
  misc_feature (71): n=t or g
tctggcttgctaatttcgtaagaaagaggcaaattaaccacaccgcttacttccaatataggaatgagggnaatctgtgaaagagcacatagagattattc

SEQ ID NO: 56117 - DNA, 101 bp, rice(Oryza sativa)
  misc_feature (71): n=a or c
tcgatctgtaacagaagtaccatgatcttgttgcagcaatgattatgcggtatatgctgagacgtgcttcnaggcatttggggacagggtgaagcactgga

SEQ ID NO: 56118 - DNA, 101 bp, rice(Oryza sativa)
  misc_feature (71): n=t or c
ggtgaaaaatctgggagcgactcattccttttgcaaattcatcgtctcctgtgcctacataactgatggantaaagttactcagagaaaagtcctgtataa

SEQ ID NO: 56119 - DNA, 101 bp, rice(Oryza sativa)
  misc_feature (71): n=a or g
ttgtcaaaaatgaaataagggtggttgttttgtggtaggctcagttgagtgtagctatttagtgatacggnaaaatgagatgagatgttattgaatgatta

SEQ ID NO: 56120 - DNA, 101 bp, rice(Oryza sativa)
  misc_feature (71): n=a or g
gggcctggaaatcctcacggcccaataggcttctacttatgcacctcttgtagtcatatggttggagtccngagaaaggagatggtatcattggcaataga

SEQ ID NO: 56121 - DNA, 101 bp, rice(Oryza sativa)
  misc_feature (71): n=t or c
atcccgattgtttataccatccgggagcaaattaagttaaaaaaaaaatagtgcaccaccgagccatgcgngcctcatcatatttagtcccggttgtttat

SEQ ID NO: 56122 - DNA, 101 bp, rice(Oryza sativa)
  misc_feature (71): n=t or g
atagatagatagatggtgtgaacatcatggaaaatgctgtgaaacaaaaggattacagagggactgactanggcagccctaatgggcgatcgatcgcccgc

SEQ ID NO: 56123 - DNA, 101 bp, rice(Oryza sativa)
  misc_feature (71): n=t or c
gtcaggaatgtgatgtaggacaagctccctaccttataaatgaactcaccaaagcaaaattaatttagttnagtggtttcagatttacctatcaaaatagt

SEQ ID NO: 56124 - DNA, 101 bp, rice(Oryza sativa)
  misc_feature (71): n=a or g
cattgccacgccagcggcgcgtggcgtgacagacttatttaagacacgccagatgtttatatttggaaatnctttttaaaaatgtctattaataaaatttt

SEQ ID NO: 56125 - DNA, 101 bp, rice(Oryza sativa)
  misc_feature (71): n=a or g
tgcttcaccttaaactcgacccactttctgtcaaattcttcatgattatatggtgcgtggagaagtgctcnaaaatctaaaagcatatcaggacgaagatg

SEQ ID NO: 56126 - DNA, 101 bp, rice(Oryza sativa)
  misc_feature (71): n=t or g
tgcaatcggcacattaatctgcaaaacggttacggcctagaccacgaagtttcagcccgtattcgcccaantcgcaaatacgggctgaaactccctccagc

SEQ ID NO: 56127 - DNA, 101 bp, rice(Oryza sativa)
  misc_feature (71): n=a or g
tagttgatttgtttataattccgttgaaatcacaagaggagcaaagttccttgttccaagtcaagatgctncgtcctgttatacttgaaaaagcaccagcc

SEQ ID NO: 56128 - DNA, 101 bp, rice(Oryza sativa)
  misc_feature (71): n=a or g
aagagtagtggagtttcttttaaaatttggacctctcccgatgaaagcgacaacgaataaagccattactntatattagcagtgcgtataatttcgattag

SEQ ID NO: 56129 - DNA, 101 bp, rice(Oryza sativa)
  misc_feature (71): n=t or c
gacaaatgagactagtatttggattgtagaattctctgaagtgcatgctgatagtgatactaggggtgganatgagagaggaggcaagctcgtatcatcag

SEQ ID NO: 56130 - DNA, 101 bp, rice(Oryza sativa)
  misc_feature (71): n=t or c
ttgtcaacatgacaacggataagatcaggtgtagacctttcagaggtataaaatattactccctccgtttntaaatatttgacaccattaactttttaata

SEQ ID NO: 56131 - DNA, 101 bp, rice(Oryza sativa)
  misc_feature (71): n=t or c
tgtttagatgacaaaaggtcaactggtggatttgctgtatatctaggtgataacatggtctcatggagtgnaaagaaacagacaattatttcaaggtcaag

SEQ ID NO: 56132 - DNA, 101 bp, rice(Oryza sativa)
  misc_feature (71): n=t or c
actgccactccatggtttggcaattatcacgaggtgcgtcgtggttccaaaaactaataaggttatcgtangtgataaccgcgataactgacggttttgta

SEQ ID NO: 56133 - DNA, 101 bp, rice(Oryza sativa)
  misc_feature (71): n=t or c
tcaagagaagaaaccttaggtcacgtcaaggctatggactcgtatatgacatgtgaggtctgtggcagaangggtcactcggggaatgactacattgagac

SEQ ID NO: 56134 - DNA, 101 bp, rice(Oryza sativa)
  misc_feature (71): n=t or c
ctcctacctcacccctctctctcttttcttttctctgccgctgggggtgcggcgggcacaacgggtaggangggtggcggctggagggcattgcggaggcg

SEQ ID NO: 56135 - DNA, 101 bp, rice(Oryza sativa)
  misc_feature (71): n=t or c
caacgagcatatcagtaattataaacgcacatcagggctagaaaaggcatatataaggtactacattcgtnccaaaatataaaaagttttagagttggata

SEQ ID NO: 56136 - DNA, 101 bp, rice(Oryza sativa)
  misc_feature (71): n=a or g
actgcacaatgagtacacactggtacaagtcattaaagttgagggttaaaaataaccaaatctactggggntaaaatggccgattacaaaatatgaggacc

SEQ ID NO: 56137 - DNA, 101 bp, rice(Oryza sativa)
  misc_feature (71): n=a or g
acggtgcggttccgcagcttcccatcttgctccttcacagcgaacggttagatttatttcgataccgtctngtaccagtaccacgaggagaaacgctaggg

SEQ ID NO: 56138 - DNA, 101 bp, rice(Oryza sativa)
  misc_feature (71): n=a or c
tattctgtctagtttttgctaggactaggggcaggatttacataatttcccctgtgctatgtgctattgcnaggtactacatatgtactaattaggattta

SEQ ID NO: 56139 - DNA, 101 bp, rice(Oryza sativa)
  misc_feature (71): n=a or g
atatgattataattaactaggtatgcgattgcgattaactcataatccaacaaagattgacgacgacgagntggacgacatgtatgccattcgaggcgagg

SEQ ID NO: 56140 - DNA, 101 bp, rice(Oryza sativa)
  misc_feature (71): n=t or c
acacgctcatttcattcagcatcgcaacaacacgtgacagctcttaaataagccaacccaaaaggatccantactgtagtagtacaatactactgctacac

SEQ ID NO: 56141 - DNA, 101 bp, rice(Oryza sativa)
  misc_feature (71): n=a or c
ttacagtggctatagtactgcttctccgaggatataatgcaaacgaccactgctcttggtgtcactatctnagctgtgttcctacgaaaagatggaaatgc

SEQ ID NO: 56142 - DNA, 101 bp, rice(Oryza sativa)
  misc_feature (71): n=t or c
agatgaagggcgcactttgtcaagaaaaatatctcgtgcccgaattgaacatcctacactgtcgcctgttngtgaggaacttcctcctatgatgcttcctg

SEQ ID NO: 56143 - DNA, 101 bp, rice(Oryza sativa)
  misc_feature (71): n=a or g
cagttaattgcagcttatttgccggcgccagatatgtggtgattgcttgtgttcgttgatgcgctgtatancatacatgcatgttccatcgatccattgta

SEQ ID NO: 56144 - DNA, 101 bp, rice(Oryza sativa)
  misc_feature (71): n=t or c
aaggaccaaaatataaaaatttcagtctgcatgcctccatctagtcatctacacttaatatcacaaagaanaacatacatgtaagccgataagattattgg

SEQ ID NO: 56145 - DNA, 101 bp, rice(Oryza sativa)
  misc_feature (71): n=a or g
ctattaaaaaacagaggtagtaagaaagtgataaaattaaaaagtgagaggttgtaattggttaaagaatncttcctccatttcacaatgtaagactttca

SEQ ID NO: 56146 - DNA, 101 bp, rice(Oryza sativa)
  misc_feature (71): n=a or c
caaattgctcctccggctggccaaatgtagccagtctctccactggctaaaggtgggtcccactaccactnttagccccatccttcctctctctctcccgt

SEQ ID NO: 56147 - DNA, 101 bp, rice(Oryza sativa)
  misc_feature (71): n=a or g
atgtttgagcaatgccttggaagttggagcacggccactccacgtaagaaatccgagagttcatacagatnggttaaatgtgtgaggttccgcagctctcc

SEQ ID NO: 56148 - DNA, 101 bp, rice(Oryza sativa)
  misc_feature (71): n=a or g
actgtgtaaaaaaaaaacacgagtacagtacatcggttattaatcaatttggtcaaatttgctagtgctcntatcaaatataccgacggaaatcaaagacc

SEQ ID NO: 56149 - DNA, 101 bp, rice(Oryza sativa)
  misc_feature (71): n=a or c
aaccggccttaaattaagctcattttaaaagacccgttcttgcgtacgactagtggactgtggagtataantacctgcatttcgcccttaatgctgtaatt

SEQ ID NO: 56150 - DNA, 101 bp, rice(Oryza sativa)
  misc_feature (71): n=t or g
gacttcatctgactgggagttgatttgtgcaatcaacaacttccaaatgcagatactactactagtactcntagtagtactactacggcctacggagtact

SEQ ID NO: 56151 - DNA, 101 bp, rice(Oryza sativa)
  misc_feature (71): n=t or c
ctctctcttgctattttatttccttacacatcaattaaatcgtctgatttggtatcaacatgcactcctangtttttgcaggtgtccacggtgtttgctat

SEQ ID NO: 56152 - DNA, 101 bp, rice(Oryza sativa)
  misc_feature (71): n=t or c
gcgcctactgcttccgaaggagacaccgttgatgattcttgtgaagacaccacaacttcaacctcaggaanggagccactcaaccagacaaacagcactgg

SEQ ID NO: 56153 - DNA, 101 bp, rice(Oryza sativa)
  misc_feature (71): n=t or c
gtggattcatatttgcgttgttgatagcgtttgatataatctgcctcgctggtcatgacgggagcgttgcnggtaccagactgtttctcctccctcacctt

SEQ ID NO: 56154 - DNA, 101 bp, rice(Oryza sativa)
  misc_feature (71): n=a or g
tgattcgggagaagactccatcggtgttgagagcttcagttcgaaatgtttgtcagttgcattcttttgtnatgcatccttttccattgtagatatgcaca

SEQ ID NO: 56155 - DNA, 101 bp, rice(Oryza sativa)
  misc_feature (71): n=t or g
atttacttttagagtttacctagagccatctacatgttttatcccttcaatttttccatacaatgctaggngaggagttagaataaattccctacatttgc

SEQ ID NO: 56156 - DNA, 101 bp, rice(Oryza sativa)
  misc_feature (71): n=a or g
ttgatccaaaataaagttaaagagggtaccatatcagcgtaattttgtttactggatcctactgcctgtgntaggcgagtcagtgttacaataattgttga

SEQ ID NO: 56157 - DNA, 101 bp, rice(Oryza sativa)
  misc_feature (71): n=t or c
taatgatgctgtccaattgtagtgtagtatgatgtgattgatatgttcatctattttgagctgacagtacngatatcgtaggatctggtgccaacttattc

SEQ ID NO: 56158 - DNA, 101 bp, rice(Oryza sativa)
  misc_feature (71): n=a or c
tagttgtgaacgaatagagtacttaataatcacgcgctaatagactattatgttttccgtatgcactgttntggatgagcacacgctggagcgaacatagc

SEQ ID NO: 56159 - DNA, 101 bp, rice(Oryza sativa)
  misc_feature (71): n=a or g
tattattcttgctctggcatggaaacttgattgagttcagtcgcctcatccatggtccaaccattcaggangttctacgcatgcgacgcctcttctataaa

SEQ ID NO: 56160 - DNA, 101 bp, rice(Oryza sativa)
  misc_feature (71): n=t or c
taccaagcaccatcacccggcagatgtccatgcaaggaaccggtggtggtggaaaggggaaattcttcccnggcaagctcactggaggcgtcaccatcact

SEQ ID NO: 56161 - DNA, 101 bp, rice(Oryza sativa)
  misc_feature (71): n=a or g
gtgttggtgatgattttgatgtaatcatgccgttctgctatgttaacccatggtggaacaagatcaaccantgttttcttcagtttcaggtcatgaagcag

SEQ ID NO: 56162 - DNA, 101 bp, rice(Oryza sativa)
  misc_feature (71): n=a or g
gcacacatcctcgccgctgtcgcggtcagtccccggcggtgacaatcatcgtgatctgctcttcaatctgnacaatgtgcgcggcgatttcatggccatga

SEQ ID NO: 56163 - DNA, 101 bp, rice(Oryza sativa)
  misc_feature (71): n=a or g
tgaccctgaagagttccttcatgtctattccacagttctctacactactagggcagatgacaatgtactcncaaattatttgcttgctgcgttgaaaggat

SEQ ID NO: 56164 - DNA, 101 bp, rice(Oryza sativa)
  misc_feature (71): n=a or g
ccgagcccgatatttgtcctgtgttcacacttgttgacaaggaaccggctcaaccgacgggttaattaagngttggcgagaaaaaaaaccactgtatatca

SEQ ID NO: 56165 - DNA, 101 bp, rice(Oryza sativa)
  misc_feature (71): n=a or g
taacatgtttacatgtgtattttcactgtgtttcacaaaactcacccctattctccctccactccatcctncatgtatttaacgatcttcaaaacgatttt

SEQ ID NO: 56166 - DNA, 101 bp, rice(Oryza sativa)
  misc_feature (71): n=a or c
caaacctttctgatcaacagggagagagctgttgactacttgaactcccttgataaggtaggctagggctntcacaccttcatgaatattgaatgttgtgg

SEQ ID NO: 56167 - DNA, 101 bp, rice(Oryza sativa)
  misc_feature (71): n=a or g
aaccaaattggtgtgctggacctgtaggtggatctttatctcattcacaaccgcgtttccatcaggcgttngtgctgcagcttttgagcaataaaaggcgt

SEQ ID NO: 56168 - DNA, 101 bp, rice(Oryza sativa)
  misc_feature (71): n=a or g
agaagcttgctccaagttcgcataaaaagatggccctgaaattgacttcaaatggtgttttgagaattttncttcaggctccatcttgttccatgcttgcc

SEQ ID NO: 56169 - DNA, 101 bp, rice(Oryza sativa)
  misc_feature (71): n=t or c
ccaatgtttcctagactacaccatcatttgagaagacatctaatgcagtcgcggagctgaaaaccacacgnaagttttgccgcgcttttgttttggagaaa

SEQ ID NO: 56170 - DNA, 101 bp, rice(Oryza sativa)
  misc_feature (71): n=a or g
acgtgtccgctttgtcgcggatacagattggtttcaactctttcggtggaatcattcctccggaggttggnaggttaagaaacctcacttcgctagaagct

SEQ ID NO: 56171 - DNA, 101 bp, rice(Oryza sativa)
  misc_feature (71): n=t or c
acgtaccttgaatagatgaaattgcagatgaactatgtggcaggggttattgtgtgctcggtatggggatnagtgatctcttcttgttgctcaatcgagtg

SEQ ID NO: 56172 - DNA, 101 bp, rice(Oryza sativa)
  misc_feature (71): n=a or g
gtttacataaacatgaacagtaatgctttaagttctattcaaacacattatactcctcagtctcagcccancctttcgttctcttaaccttcccagatgtt

SEQ ID NO: 56173 - DNA, 101 bp, rice(Oryza sativa)
  misc_feature (71): n=t or c
cgcagcttacccggatcccagttgtgcttcactagccgcggcactaggattcgacgacatcgtgtggattnggttggatccaagccttgatgcatctctct

SEQ ID NO: 56174 - DNA, 101 bp, rice(Oryza sativa)
  misc_feature (71): n=a or g
gagtgggagaggccagcgaggattggtcggaagaggcggtgacttctcacctagacttgttgtctccgtcnactagatccgatacgggacgacggtctaga

SEQ ID NO: 56175 - DNA, 101 bp, rice(Oryza sativa)
  misc_feature (71): n=a or g
ttacagtttatcacaagacagaaaagtaattatctctgatgaattgttaggcgaaccaatgctggaggatncaatctggactcaggcctgtttgggggaac

SEQ ID NO: 56176 - DNA, 101 bp, rice(Oryza sativa)
  misc_feature (71): n=t or c
actaatcaattatttggtagagctagagccgcatgaggacaataagccattgtcttccttgaggccgcaanaggatctcttgcttgggaaaagcttccatg

SEQ ID NO: 56177 - DNA, 101 bp, rice(Oryza sativa)
  misc_feature (71): n=a or g
ctgccatgggctcgctggacaaggtggtagccaagttcatgacgccgacgatggattccatgctggagaangtgcagaaggtaccaccatgctgctatcta

SEQ ID NO: 56178 - DNA, 101 bp, rice(Oryza sativa)
  misc_feature (71): n=a or g
tgttgattatttgattatttcttcaacttgttttggaaggtctccttatatgtacgggacgtcttactgtnacatatttcacaaaggtgtgtgtttattat

SEQ ID NO: 56179 - DNA, 101 bp, rice(Oryza sativa)
  misc_feature (71): n=t or c
taacagcgaccacaaggaaagagcgagcaattccactaggagattttgattcagtggtgtttatcaagtantagttccttgactcctagacgaaatattta

SEQ ID NO: 56180 - DNA, 101 bp, rice(Oryza sativa)
  misc_feature (71): n=t or c
gacgagcgaacgaggaaggaaggaagcagcgattgccgagaagatgaactatggcatgtgggaaacgcgangacttggcgagagatgaggtggattagctt

SEQ ID NO: 56181 - DNA, 101 bp, rice(Oryza sativa)
  misc_feature (71): n=t or g
catcggggcattggtcttcaccacttaatattcttctatgcaataaccttctcgagtcaacatcagaaagntgttttatttcataaacatgaccgacttcc

SEQ ID NO: 56182 - DNA, 101 bp, rice(Oryza sativa)
  misc_feature (71): n=t or g
cgaatccgcatcacgaacggaacagctctgatgcatgatggcttgctagatagcctttagacaatggaatngctatctccacctttcggtgccgcgcgtca

SEQ ID NO: 56183 - DNA, 101 bp, rice(Oryza sativa)
  misc_feature (71): n=a or g
tattgatcagaacgttactaactcaatctatacatcaaatacagatatttgcttgacgggtggcctgttcnaatgcaaaaagaaattagagagcaaaactt

SEQ ID NO: 56184 - DNA, 101 bp, rice(Oryza sativa)
  misc_feature (71): n=t or c
caaatgcccgcttagccctgatcaagccagtgttaatggcgctcccactctacatgtccgttggaactacnagcctgggcaatcaacgaaatcgaaaagaa

SEQ ID NO: 56185 - DNA, 101 bp, rice(Oryza sativa)
  misc_feature (71): n=a or g
accaataaataaatcaagcgaacttcgctggttttaacaaaccggttggtctttcctgataagtagggatnggagagtgtcctatgctgaaaaatggactc

SEQ ID NO: 56186 - DNA, 101 bp, rice(Oryza sativa)
  misc_feature (71): n=t or c
agatgagaaacaatcaatgttgaaacagctataatttttcataagctacacatccgtttacttatatgttncggttaatatttcacctttataagtttctc

SEQ ID NO: 56187 - DNA, 101 bp, rice(Oryza sativa)
  misc_feature (71): n=a or g
gtcgcttacacatcttattaagctccaaagtttcacacacacgccgcaatttatgtatagtactgtgtaantcctgtttatatggagaaattaggtcccta

SEQ ID NO: 56188 - DNA, 101 bp, rice(Oryza sativa)
  misc_feature (71): n=a or g
gtgtgcctgaaggcgttctagtacctgatgcatcatctgaagtcttctcgccatggttgatcgctgaaatngaccctatgatgttgatggtcactaagtgt

SEQ ID NO: 56189 - DNA, 101 bp, rice(Oryza sativa)
  misc_feature (71): n=a or c
caatgtggcagaagaagggtacagtgcactaaacttcacctcgtgccaaaagcaaacctgatggttacttnctctctaactacccatccttttatttcttt

SEQ ID NO: 56190 - DNA, 101 bp, rice(Oryza sativa)
  misc_feature (71): n=t or c
atgccagaaaaggaagtcaagccaaatattggtagctatgagctgttgttgagggcgtatattgatgctgngaggttggatgatgcaattaagatggccaa

SEQ ID NO: 56191 - DNA, 101 bp, rice(Oryza sativa)
  misc_feature (71): n=a or g
tgatcgacgaacatgtatatactaggcgtgtattttgcatgcacatagttattccttaacagcgatgctanccaagcttttgtttgaaccgatcatacata

SEQ ID NO: 56192 - DNA, 101 bp, rice(Oryza sativa)
  misc_feature (71): n=t or c
tcaggggtcaatgtctatagtacaattggtacatgctagcccacccaactacgtacaaaaacgaattttanggaccgtctatttaattgtaggcggactaa

SEQ ID NO: 56193 - DNA, 101 bp, rice(Oryza sativa)
  misc_feature (71): n=a or g
ttcgacgaattgctcaagctgtgattcgctttgatataattcacaaaggaaagcaccttggaaacaatggntagcacaattgatgagaagaaatagttttg

SEQ ID NO: 56194 - DNA, 101 bp, rice(Oryza sativa)
  misc_feature (71): n=a or g
tgtaccttttagtgttgagcttaaagctactcactctaacaattctgtcctggaaactagcagatgggtcngtgtttggaaagggaagagaactgattacc

SEQ ID NO: 56195 - DNA, 101 bp, rice(Oryza sativa)
  misc_feature (71): n=t or g
ccttgtccttccgcgtgttgcaagtttttaatactactacttatgtacaagtattccaacccgcacatatngtttgctatgatattgttttgcgaatttgc

SEQ ID NO: 56196 - DNA, 101 bp, rice(Oryza sativa)
  misc_feature (71): n=t or c
gtactacataccaaaattctctttcttgacttcttgattggccaattaatctacggcgcattgcactgctnaattatttggtgagtgagaatgagaagaga

SEQ ID NO: 56197 - DNA, 101 bp, rice(Oryza sativa)
  misc_feature (71): n=a or g
ctggcagctacacatttctgacaaattttgctgttatgtttgacctcagataaaagctcggggcgatgganaaccgttgtcgtcgtcgtagttgtggtcgt

SEQ ID NO: 56198 - DNA, 101 bp, rice(Oryza sativa)
  misc_feature (71): n=a or g
aatatccagtttttccatctgttcatctagcttatttccatttccttccatgttggttggcggatcttgtngtttcatgtcgacaatggtcccagaacttc

SEQ ID NO: 56199 - DNA, 101 bp, rice(Oryza sativa)
  misc_feature (71): n=t or c
ctcatgcggcctgtatctccctccaaaccgaggaagattaggattggcacacacagattgttgaaagttangctgcaatccttggggtggcaacacatgtc

SEQ ID NO: 56200 - DNA, 101 bp, rice(Oryza sativa)
  misc_feature (71): n=t or g
cgagcgaatcatctttgactaatcatcgccaccagataatggcaaaccttgaatctttagattttgggagnttttgaccgtgagaacacctgagcccggcc

SEQ ID NO: 56201 - DNA, 101 bp, rice(Oryza sativa)
  misc_feature (71): n=a or g
gatcttcgaaatataactttgaacactaatgtctattattgtgatatatctgtaaggcccaacaagagctntactaatactgtgaagattcattctataaa

SEQ ID NO: 56202 - DNA, 101 bp, rice(Oryza sativa)
  misc_feature (71): n=a or g
ttcgattgtccagtcaggcgcaacaggtggagattggggaagcacgaaacaatattttgaagtacatgcantctgatcaaaaaccctgtttaggttggcat

SEQ ID NO: 56203 - DNA, 101 bp, rice(Oryza sativa)
  misc_feature (71): n=a or g
atttaccatcaattgttaaccaaactctctatgtaccaccaaaaagatcttctattccttcaggacaattnctttcaaagtttaccattttttaccatttc

SEQ ID NO: 56204 - DNA, 101 bp, rice(Oryza sativa)
  misc_feature (71): n=t or c
cccctgctcgttgtcaccatcggtggactaatgtcgatgaaggaacaaacagtccaggtttggaagaatgngcttgacaacttgcacaagaagtacctccc

SEQ ID NO: 56205 - DNA, 101 bp, rice(Oryza sativa)
  misc_feature (71): n=t or c
ggcgggcccgcatggcagtcccatggaccaccttgtggtctcagtacacggtggatcaactccgtttgagntgctgattcgtggggcccactttttgtgga

SEQ ID NO: 56206 - DNA, 101 bp, rice(Oryza sativa)
  misc_feature (71): n=a or g
aggagggtatgcccttggcctcatgaacggtgcattccctattgcctatgacacggattggttcatagccntcgagtttgacacgtacaacaacccctggg

SEQ ID NO: 56207 - DNA, 101 bp, rice(Oryza sativa)
  misc_feature (71): n=t or c
ataaatatccacatttcaactatgtgtttccccaaagatttattgttgcaatatcttacagctaaatccgnaaagtcatatgttctatagcattttttttg

SEQ ID NO: 56208 - DNA, 101 bp, rice(Oryza sativa)
  misc_feature (71): n=t or c
tcagatggcatcgtcgaaatctcaatgttggagccgtgttctgctgatgcaattgcccttcctttatcctnaattcctaccatcgagccaatggaagatgc

SEQ ID NO: 56209 - DNA, 101 bp, rice(Oryza sativa)
  misc_feature (71): n=a or g
ttttttctttcgcctattcttactatgcaaatcgtcttttgccctttttgcattgtctatcagggtgttcnccgaaagttgtgcattcagcctccttccgg

SEQ ID NO: 56210 - DNA, 101 bp, rice(Oryza sativa)
  misc_feature (71): n=t or c
ttatttactaactcgccattagtcactttttcttactacatagcacctactcgatcttttcttcgacaacntttctagaagctgtcaactttggaactgct

SEQ ID NO: 56211 - DNA, 101 bp, rice(Oryza sativa)
  misc_feature (71): n=t or c
agccatgttgcgaagcacacggacttcgctggagatggaccttgtcagaagaagactacgcgggcgaaggntgtatgatgaaagccatatcgcgaggcacg

SEQ ID NO: 56212 - DNA, 101 bp, rice(Oryza sativa)
  misc_feature (71): n=t or c
caactatatgtatgcttttcaattacgtactccacgagacatccgaagatgtgatgcgccgaaaatgcgcncacgagtacacatgtagaaaagcaactcct

SEQ ID NO: 56213 - DNA, 101 bp, rice(Oryza sativa)
  misc_feature (71): n=t or c
ttattgctgctgttggttgggatgggaggtctgaagctgatctgtttgtagagatcagtagaaaggcatgngtatttactactgcataattgaggataatg

SEQ ID NO: 56214 - DNA, 101 bp, rice(Oryza sativa)
  misc_feature (71): n=t or c
agatgctcatctctctattttccctttttggctgttttagagccccaagaaggtgaatctggtagcaaagntggttcgaggaatgcgtgtggaagatgccc

SEQ ID NO: 56215 - DNA, 101 bp, rice(Oryza sativa)
  misc_feature (71): n=a or g
aaatctttccaccccttaagtatctgatctacaccccatcgtaagtgcaacactcttctctcatgtatctntcatagaaatgtattaccaacgtgatgaca

SEQ ID NO: 56216 - DNA, 101 bp, rice(Oryza sativa)
  misc_feature (71): n=a or c
atacttcgactactactgctacaaagcctcagcggtgattaactaaaagacatgtaggggttacagtgacntgagtagtacccaaaggtcctgagttcaaa

SEQ ID NO: 56217 - DNA, 101 bp, rice(Oryza sativa)
  misc_feature (71): n=t or g
cgattaggaactgaacccttcacaatgcaactaaaatgtttggtctgaaacagcagatccaagcaagtaanttacctgattatgaatgcgctttcctgtct

SEQ ID NO: 56218 - DNA, 101 bp, rice(Oryza sativa)
  misc_feature (71): n=t or c
aatgcctggcaaagtgaaaggaaaagagaggactcatttccacgcagcatccgcatggcattgtatctgantagggagtcagaaacggcttgtaatccctt

SEQ ID NO: 56219 - DNA, 101 bp, rice(Oryza sativa)
  misc_feature (71): n=a or g
gaggatgtttgcttacattaaattccttaccagtggtacagacatggttcgctctccggaggttctgaagngttctttatttaagtttcctgtatctaagg

SEQ ID NO: 56220 - DNA, 101 bp, rice(Oryza sativa)
  misc_feature (71): n=a or g
gattgtgttgttgatcctagcagctttcttctccttctggatccgttgaatggaaataaaggtggctctcngtggtttccagattgagaacggaaacaacg

SEQ ID NO: 56221 - DNA, 101 bp, rice(Oryza sativa)
  misc_feature (71): n=a or c
ggtctcactgtagtttcttcctaaggaatgatcaatcatctctgcaattgctccctcttcccagtgcctcngtacctagcaacattagtcacacatatgtg

SEQ ID NO: 56222 - DNA, 101 bp, rice(Oryza sativa)
  misc_feature (71): n=t or c
tgagggtggtaagcagaactgaggtgtagtttagtgcctaacctgataaagagttgttcccataatgtacnggtgaaaattctatctctatcagaaacaat

SEQ ID NO: 56223 - DNA, 101 bp, rice(Oryza sativa)
  misc_feature (71): n=a or g
aaaaggcttatgacaaagttaaatggcagttcctacatcagacattacgaatgaaagggttttcacaatcntggtgcaattggatttccaactgggttgaa

SEQ ID NO: 56224 - DNA, 101 bp, rice(Oryza sativa)
  misc_feature (71): n=t or c
tgtacaaaatacttcttccattatatatattgctagcaaaatctccagacctatacttcttcttcctcgcngatgagatccctcccccaagctagcacgca

SEQ ID NO: 56225 - DNA, 101 bp, rice(Oryza sativa)
  misc_feature (71): n=a or c
catcttgcttcccatcgttgggaacgcagcagagcatgccggtgccgtcatatttgctctcaagaacaagntggtactccatataattaagcagcacacac

SEQ ID NO: 56226 - DNA, 101 bp, rice(Oryza sativa)
  misc_feature (71): n=t or c
ttacttgttaattaatcagttaacacaagctcctcttcctgggacgtacaagagctaagataacttgttgnccggtaaccttttgcaagcactgtaacata

SEQ ID NO: 56227 - DNA, 101 bp, rice(Oryza sativa)
  misc_feature (71): n=t or c
catgtctgctctggtttggctgttagctcattgaggatttgacaaaagagaagttcgccttacaacgtacncttgagaaatctcaagaattggctcaaact

SEQ ID NO: 56228 - DNA, 101 bp, rice(Oryza sativa)
  misc_feature (71): n=t or g
gttttctcctatgctattttgtaactagcaaacctggtcctgacgttagagtatgaaatgcttttggcacncaaccttggcaacgtggaaatcattgcctg

SEQ ID NO: 56229 - DNA, 101 bp, rice(Oryza sativa)
  misc_feature (71): n=t or c
ctgggatgtagatatactggatggtcttgatgattcgatcagcttgctcttcctgcagctggaagatcctncgcccttccatgaagctgctgccgaacgcc

SEQ ID NO: 56230 - DNA, 101 bp, rice(Oryza sativa)
  misc_feature (71): n=a or c
acagcagagagatgctcttctctaggagtctccatgaatctgctgacatacccgattgcatatgccaggtnggggcgggtgttgacgaggtaacgaagact

SEQ ID NO: 56231 - DNA, 101 bp, rice(Oryza sativa)
  misc_feature (71): n=a or g
tggaacctttttctccttcacgaattcccttctaatattgtcttctgacggacacgatgtgatgtcttcanggcctcctcgacgtcattggcccacagcag

SEQ ID NO: 56232 - DNA, 101 bp, rice(Oryza sativa)
  misc_feature (71): n=a or g
ataaaggccgtcatatctgtattatgataagaaccttgggccggccggcaaggaagagcctgaattcgccngagctcccgccgccttccaaccatggacaa

SEQ ID NO: 56233 - DNA, 101 bp, rice(Oryza sativa)
  misc_feature (71): n=a or g
cagcctcaccggtttgagctgcaacattgcagtgcagtccatccaagaaacgtacaacaacaaaccgacantgaatgcactgaattgccgaaaaggaatca

SEQ ID NO: 56234 - DNA, 101 bp, rice(Oryza sativa)
  misc_feature (71): n=a or g
ccaggagctgaagaggggaatccagtcattccaggatttcaagctcatatgaacgaggagatcggcaaatnaagtggcacaccgtttggctaaggaaagcc

SEQ ID NO: 56235 - DNA, 101 bp, rice(Oryza sativa)
  misc_feature (71): n=t or c
actctacaggtaccgtgagatgtttccagctagtaaaaagggattaaatctccttgagaattcgaagcagnatggtggcagaaaaaattcaccaagttcat

SEQ ID NO: 56236 - DNA, 101 bp, rice(Oryza sativa)
  misc_feature (71): n=t or c
gccaagctatgtactccctttcaaattgcttagcaggtgaagcatctgcaaagaaccattcctactgttanagacttcagatagcttaatagcagataaag

SEQ ID NO: 56237 - DNA, 101 bp, rice(Oryza sativa)
  misc_feature (71): n=a or g
tttcttgtaccttctgaccaatccgaagcaaaagatgacgcagcaaaatgatccaagaagtgggaaaatcntggccatggccatgactttgctcctcctcc

SEQ ID NO: 56238 - DNA, 101 bp, rice(Oryza sativa)
  misc_feature (71): n=t or c
ataattatattggccatgcctagtatcggtgggatatcccctactaggatcattataagcattgggaacangtgggggaacttgggaacaagcaacaacag

SEQ ID NO: 56239 - DNA, 101 bp, rice(Oryza sativa)
  misc_feature (71): n=a or c
cccatcgcttgtgggtgaagcgcatcgagctacatgatgccgccatagaagaggtgacgttggtcaacaangtcatcaccgacctccacctcgccttcgaa

SEQ ID NO: 56240 - DNA, 101 bp, rice(Oryza sativa)
  misc_feature (71): n=t or c
gtggcccattcaattcctaggttgacaacaaactgaatgacatagtttctgcaaaaaaaaagaaatcatangttattaaaaaacattactgtaatattact

SEQ ID NO: 56241 - DNA, 101 bp, rice(Oryza sativa)
  misc_feature (71): n=t or g
gatactaaagaactgcaagaaagccattccatctagagatgctggaggaaaggtaatagtcgtagacatgntggtcggagtagggccacctgatcaaaagc

SEQ ID NO: 56242 - DNA, 101 bp, rice(Oryza sativa)
  misc_feature (71): n=t or c
tactcggttcctcaattcttcattggtttaattttcattcctcaatgcaataccaaacggaatccatcccncaactatcaaaaccatgcaaataatatccc

SEQ ID NO: 56243 - DNA, 101 bp, rice(Oryza sativa)
  misc_feature (71): n=a or g
aattgattttgtagtagtgagaaagaagagtttgacctagatgaagcagttctgagagcagtcacgcaaanaacacgctctctaaaaacttgatcgcccgt

SEQ ID NO: 56244 - DNA, 101 bp, rice(Oryza sativa)
  misc_feature (71): n=a or g
caaacagtcgtgccgtgatgtggagattgaattccctgtcatcaagctgatgttgcaggtggagatgatcntgttagatggcgagttcgaggaataaattc

SEQ ID NO: 56245 - DNA, 101 bp, rice(Oryza sativa)
  misc_feature (71): n=t or g
tttcacccagctttctgactttcaccatgtttgacagtcgtttggcatcctgcagactcgagcaattgagngctgtggtgttattctagactatcgtcaac

SEQ ID NO: 56246 - DNA, 101 bp, rice(Oryza sativa)
  misc_feature (71): n=a or c
acccttgtccaccaaccaaacacactcaaaaactgaatcgtcatctcccatctagggatattcctccaacnaaatacaccctaataggcgcaccaggtatc

SEQ ID NO: 56247 - DNA, 101 bp, rice(Oryza sativa)
  misc_feature (71): n=a or g
agcttggtgcaacttgataggttgagcaacttaagttcatcaagaccggagatagatgaaggtaactcacngatttcaggacagcatgacaggctgaggtg

SEQ ID NO: 56248 - DNA, 101 bp, rice(Oryza sativa)
  misc_feature (71): n=a or g
ttatctgtagaacaaagcaagggatgatattctctgcataggtaaagcctaaaggaacacatatgtcggangcaacgaaccgtatcctgcatgctttaaag

SEQ ID NO: 56249 - DNA, 101 bp, rice(Oryza sativa)
  misc_feature (71): n=t or c
ccaaacaaagtctaagttcggtctatacctcatcccttgaagcaacatcatagagctatggatcgtgtganagtagtcaagctagttaaaattgaacttaa

SEQ ID NO: 56250 - DNA, 101 bp, rice(Oryza sativa)
  misc_feature (71): n=a or g
gccatcgccgagcgatcgctggaggggctcgtcaccttcctcacatcctacttccgctacctccccacctnggacgcgctccgctacctgcgcctcgcgaa

SEQ ID NO: 56251 - DNA, 101 bp, rice(Oryza sativa)
  misc_feature (71): n=t or c
tgcaaagcttccaaaatcagtgaagttctacaatatttacggaactgattatgacactgcccataccgttnggtaattttcctatctggacacctgtaatt

SEQ ID NO: 56252 - DNA, 101 bp, rice(Oryza sativa)
  misc_feature (71): n=t or c
atctattgtgagattcattggtcggaggtatcccacttggctttgcagtaccattttgtcttccctaaaanacctagaactcttagatgcaaatcctgcat

SEQ ID NO: 56253 - DNA, 101 bp, rice(Oryza sativa)
  misc_feature (71): n=a or c
taggagtaacatgcagtgcggcacattttgttgaccatttgtttgacttggttgttacagatcaggtgcancaaggacccgtcgtgctcgggcaacatcga

SEQ ID NO: 56254 - DNA, 101 bp, rice(Oryza sativa)
  misc_feature (71): n=t or c
actcagcgagccataccatataccaaatagaacaagattattgacccatttttatttctcggagcaagatngatcgacggcacatggatctatctcgtaac

SEQ ID NO: 56255 - DNA, 101 bp, rice(Oryza sativa)
  misc_feature (71): n=a or c
tagagaaggataattgtggtctatcggaagtttgtagtcctcatgagacattggcaaaacgaataaagcanaagatggttttacttgtgctggatgatgta

SEQ ID NO: 56256 - DNA, 101 bp, rice(Oryza sativa)
  misc_feature (71): n=t or c
ctcatcaccaggcaccagcagcgtactactcttgtccccgtgcttgcatatggagtagtagtagttgttgngtttgtccaatgtctcgatgtggcgcggcc

SEQ ID NO: 56257 - DNA, 101 bp, rice(Oryza sativa)
  misc_feature (71): n=t or c
taatccatgtacgtaactccaagcccaagtaaagtccgatgaggcccatcgtcacgcgcaggtggcgacanggaacgatgtacgaaaatcaggcaaaaaca

SEQ ID NO: 56258 - DNA, 101 bp, rice(Oryza sativa)
  misc_feature (71): n=t or c
tcgatggtataaatcgaactttttctttaagaaacacggacaaaacacagacgctcacaacgcatgtatanttacccatatgaacgtacacacgtatactc

SEQ ID NO: 56259 - DNA, 101 bp, rice(Oryza sativa)
  misc_feature (71): n=t or c
cttgccttgtggccatagtccaggcatcgcatcatggcgaagcagctgtccttgccgccgctgacgagcgncaccacctccatctccgccgccgccgcctc

SEQ ID NO: 56260 - DNA, 101 bp, rice(Oryza sativa)
  misc_feature (71): n=a or c
ttaccgatgggcatgctctgagcttcagacatgcacccacactattcttgtgtggcacatagctaccagcntctgtgagattaagcttgctaaaaacgaag

SEQ ID NO: 56261 - DNA, 101 bp, rice(Oryza sativa)
  misc_feature (71): n=a or g
atggttgcttggatggtaaacggtaacataccatgggttcgtactataaattgttcatgcgcattctcacnatgttctcttataccctcgtctctctctca

SEQ ID NO: 56262 - DNA, 101 bp, rice(Oryza sativa)
  misc_feature (71): n=a or g
gacactacggcatgcataggaattgttattgatgtcttgcgtagcttcctggcaagtaaaactcacgacancccaccacatcttcatatcattttcttgag

SEQ ID NO: 56263 - DNA, 101 bp, rice(Oryza sativa)
  misc_feature (71): n=t or g
tgtaggtgcagtgctgtccgtaggagttggtggtatttgctgtcatcctgaagctttaaggtgttgtttgnttcactcccaatcattgccaaacctccatg

SEQ ID NO: 56264 - DNA, 101 bp, rice(Oryza sativa)
  misc_feature (71): n=t or c
ttttgctttccgcaatgcgcataggcacgcaagtacgaagaaccgctggtgtctaaggaaataactccctnccccatgagccgatgccacagcaaggcact

SEQ ID NO: 56265 - DNA, 101 bp, rice(Oryza sativa)
  misc_feature (71): n=a or g
gcccatgatcggaaacccttaaaaaaacaagtgaatggtacagtaatgtattgcggtgacagcgccaaccncgacttgtgtcggtgcgtggggtctggtga

SEQ ID NO: 56266 - DNA, 101 bp, rice(Oryza sativa)
  misc_feature (71): n=a or g
atgttggctgctgggttaatctctcccagctgcagtccctttgcatctcctgttattttagtgaagaaaanggacaattcctggcgcttttgtgttgatta

SEQ ID NO: 56267 - DNA, 101 bp, rice(Oryza sativa)
  misc_feature (71): n=a or g
aaattgcataagacggtgaaacgaattaccggagaatgtttgctgaaccattccgtaaggttcaggtctantgtgtaaggatctccgtggaagaaatcagg

SEQ ID NO: 56268 - DNA, 101 bp, rice(Oryza sativa)
  misc_feature (71): n=a or g
ccgaggcctaggcctaacgctggatgggctcacagcgatcttccccatcatgccaagtcctatatgtgttngtgcaaggcttggcgcgcacttgccggcgg

SEQ ID NO: 56269 - DNA, 101 bp, rice(Oryza sativa)
  misc_feature (71): n=a or g
attccacggtacttatgcaggggggatcctagtattgcatatgagtatatcaggatgatagtggcaacccncaagcatgtactagcactcaggcagcaagc

SEQ ID NO: 56270 - DNA, 101 bp, rice(Oryza sativa)
  misc_feature (71): n=t or g
gctgacctggcagaattggatgtactgctggagggactcatcgtctagccgctgcaccgcgtgcaagtccncttcttctcccgagcccagatacgtgccct

SEQ ID NO: 56271 - DNA, 101 bp, rice(Oryza sativa)
  misc_feature (71): n=t or g
acacaagtactccaaatagtaaaccaaggtgatgacttcatattgatcagatgagtactctgtggtgctanggatgggacattaagtgaaccagagcccaa

SEQ ID NO: 56272 - DNA, 101 bp, rice(Oryza sativa)
  misc_feature (71): n=t or g
taaacaccatccagattactgcaactttcaagcataaacggacgctgagacacaggtaagtaattatcaancacaagctttgcactactgactacactgag

SEQ ID NO: 56273 - DNA, 101 bp, rice(Oryza sativa)
  misc_feature (71): n=a or g
ttgctggctatgaggacaaacaaccctggtcattacagattgattgcaaacatgtatatagcagcaaaatnctggccagaactagctaaagtgagatcact

SEQ ID NO: 56274 - DNA, 101 bp, rice(Oryza sativa)
  misc_feature (71): n=a or g
tgcatgtagctgatatgaggcaaggaagtagttgacatacatgctgcatgcaacaaatatgtagggtgcancacacgcagagatgaggcaaggaaatactc

SEQ ID NO: 56275 - DNA, 101 bp, rice(Oryza sativa)
  misc_feature (71): n=a or g
gcacggcatggtgatcaagcttggcctggagcacgacgtctacacctgcaactcgctcgtcgcgttctacnccaagcttggcctcgtcgaggacgccgaaa

SEQ ID NO: 56276 - DNA, 101 bp, rice(Oryza sativa)
  misc_feature (71): n=t or c
aacgcccaaaccaaaaagataaaaaaaaaacccaacgccccctctctaatcaacccctcccctaaccttancaccacccaaagccctacccgccccactca

SEQ ID NO: 56277 - DNA, 101 bp, rice(Oryza sativa)
  misc_feature (71): n=a or c
aagaaaaaaaatcaattacatgagtgaaatgaaatgggatgggacaggggttgcaatttatcattttaganactcatcttcatcatacctctccacgaagg

SEQ ID NO: 56278 - DNA, 101 bp, rice(Oryza sativa)
  misc_feature (71): n=a or g
tctactgagctccaatggacatatatagacgccgtcacgctactgaaattccagagagaaatgatgacgtngcgagatcacatgatgacgcaagccgtcgg

SEQ ID NO: 56279 - DNA, 101 bp, rice(Oryza sativa)
  misc_feature (71): n=a or g
gccagccatcaaaatatataactcttgtgtccctctgatttttaacaaaatgttcaagtatcccttgcacngcccaatcaaaagtatcccaatttacattc

SEQ ID NO: 56280 - DNA, 101 bp, rice(Oryza sativa)
  misc_feature (71): n=a or g
acaatatgacaccaataggtgaaaacaactagatgaaagcagcaaacctctcaatctcatacaaaagggcnaaataggattaggcataagataaaacaggc

SEQ ID NO: 56281 - DNA, 101 bp, rice(Oryza sativa)
  misc_feature (71): n=t or c
tctatgctgactggatattcacagcacggtttgagtgccgatgccttgaagttcttcagatgtatgtgttnggaaaatgttagaaccgatgagtatgcatt

SEQ ID NO: 56282 - DNA, 101 bp, rice(Oryza sativa)
  misc_feature (71): n=a or g
aaaaaatttggggcacctaattttggggcctgttcgatcactcatttcacacgccctcattgacggtcttnatgtaaagtcggaggtatataggtcactga

SEQ ID NO: 56283 - DNA, 101 bp, rice(Oryza sativa)
  misc_feature (71): n=a or g
acatgtggaccggtgggccggccctttaacgataatgggcctggagttgtctgttcattattaagctttgnaataagttcactttaggtccctctatttct

SEQ ID NO: 56284 - DNA, 101 bp, rice(Oryza sativa)
  misc_feature (71): n=a or g
aatgcagctaggaatgagagtgcggctgttggaagaacagcgatcaagactactttcatgtagtcatgatnctcctctgaaggtgaaactggaggtgccac

SEQ ID NO: 56285 - DNA, 101 bp, rice(Oryza sativa)
  misc_feature (71): n=a or c
gctgcatgcatgcatgcaatgctgactagctatcattttacacttggaatttggtgattggtctccttggnacttgcactggatggtggtggctgaacctt

SEQ ID NO: 56286 - DNA, 101 bp, rice(Oryza sativa)
  misc_feature (71): n=a or g
gccgacttccaaaccaatatgagaaacaagaaggaatcttgcataccaagacgttcaatgacactttgtgncaagtagcttgagagttgtttccaatctcc

SEQ ID NO: 56287 - DNA, 101 bp, rice(Oryza sativa)
  misc_feature (71): n=t or c
ttggattcaatgacatgtttcatggtaatttggacctcacaaatttcctagcatgaaaaatttaagcatgnaaacactaaccatattattgatttcttttt

SEQ ID NO: 56288 - DNA, 101 bp, rice(Oryza sativa)
  misc_feature (71): n=a or g
tcttcttcttcgtcttctgtccggcatcatttttgtccttccttgcagtcatataatccctcaaaagaacncgtgaacgtttctcaggggctttaactctt

SEQ ID NO: 56289 - DNA, 101 bp, rice(Oryza sativa)
  misc_feature (71): n=t or c
tttcctctctgaagatgagtcatagttcggatgaagattcggaaatcagtgattctgagatcgacgagtangcagacaaattttatgcacgactggtggca

SEQ ID NO: 56290 - DNA, 101 bp, rice(Oryza sativa)
  misc_feature (71): n=t or c
tcttcttcgtcggaggaggaggatttgctcttgcttttggatttcttcttgggcttttcatcatcttcctnatcggagctcttgcccttggatttcttctt

SEQ ID NO: 56291 - DNA, 101 bp, rice(Oryza sativa)
  misc_feature (71): n=a or g
gcacagccaagctcaaaagcaccctggaaaaacataatgagaatgaagacaaatcatcattagtctgatcntggtcaattccagcaaatgttaaaacataa

SEQ ID NO: 56292 - DNA, 101 bp, rice(Oryza sativa)
  misc_feature (71): n=a or c
tgattgaatggtgggaaaagaggacatcccagcaggacaagagacaaacaaagggattgcgatcgctacangtgcttctctgttgggaagtatggtgtgaa

SEQ ID NO: 56293 - DNA, 101 bp, rice(Oryza sativa)
  misc_feature (71): n=t or g
atcgttttattctgggtctaaaggaagaaatccgctcagctgtgctggtccagttacctgacactgttcancaggctgctgcaattgctttagtgcaagaa

SEQ ID NO: 56294 - DNA, 101 bp, rice(Oryza sativa)
  misc_feature (71): n=t or g
tggagagagttgcttattggacagcctattttacctaaaagattaactgagtatgggtgtgcaagtgttgngtttaattatttctagaatatttggtatct

SEQ ID NO: 56295 - DNA, 101 bp, rice(Oryza sativa)
  misc_feature (71): n=a or g
taggcggagcttgttcctgattgagaacatggtcccaccagcactagctaatcaggttagttcattttgtnatctttgttgttttactctatcatgtcagc

SEQ ID NO: 56296 - DNA, 101 bp, rice(Oryza sativa)
  misc_feature (71): n=t or c
atcagtcaaacataagtatgccttaaactaaatcgaggggggatacagcacctcagttcagggtcgctganacattgtgtaaaaaaccatccctgcttgca

SEQ ID NO: 56297 - DNA, 101 bp, rice(Oryza sativa)
  misc_feature (71): n=t or c
gcacctggagactcatcccatgattcggaggatcttgtgagtgtgctttcccactggattatcataggttntgtatatgagtatattttccatccttgaga

SEQ ID NO: 56298 - DNA, 101 bp, rice(Oryza sativa)
  misc_feature (71): n=a or g
ctctattactgccaagaagctctttcacctctcttataagatacgctaattcagacatatccttcttcttngactggatcatttgtattgccaccaaacaa

SEQ ID NO: 56299 - DNA, 101 bp, rice(Oryza sativa)
  misc_feature (71): n=t or c
cctgtccacggcgcactcccaatcccaagcggtcggaaaccgtatgcgccgccgtcgctgtcatcaaaccngctgttgcggctttgcggcgccaccatgtc

SEQ ID NO: 56300 - DNA, 101 bp, rice(Oryza sativa)
  misc_feature (71): n=a or c
atttagcaagaccattcgcatgccagataagatcatcacaggcaaaggtgtgttggccatagaagaacgtntggtatgccaaacgcaccgagtagcgcttg

SEQ ID NO: 56301 - DNA, 101 bp, rice(Oryza sativa)
  misc_feature (71): n=t or c
cggtcctgactactacttctgacacaaaccatcttaaaaagatgattagcgtggtggataacgagtcagcnctgatcgttaaggttcgacttaattaggct

SEQ ID NO: 56302 - DNA, 101 bp, rice(Oryza sativa)
  misc_feature (71): n=t or c
tgatgagtgggattcatagacgcataattggctactcataccttaatgtgctcctaatcacaaatcgacancataaattccgcaatgcaaaataatgagca

SEQ ID NO: 56303 - DNA, 101 bp, rice(Oryza sativa)
  misc_feature (71): n=a or c
aattggagaagacttgagcagaactgaagagaagcacagggcaggagcagctcataatccttctctgggcntttatttttcttgtaacattacagagttct

SEQ ID NO: 56304 - DNA, 101 bp, rice(Oryza sativa)
  misc_feature (71): n=t or c
tatcacctttgcaaaaaatgtgaatgttctgtcttcctcagggagtataaatttggagaccaaaaggaggntggttgacgaagtcataaaggagtctcact

SEQ ID NO: 56305 - DNA, 101 bp, rice(Oryza sativa)
  misc_feature (71): n=a or g
ctcagaagacacttcattcctgatgcttgatccatcgccaaacttcccgagatagcttcgtcctcgggctncagcaagatgagcatagtatagtgggggaa

SEQ ID NO: 56306 - DNA, 101 bp, rice(Oryza sativa)
  misc_feature (71): n=t or c
ccccgctactaggcctaggtctatctttaacaccaagcgtgcgtgccatatgcacctagcagatctaacantgacattcaaacaattaaagtgaatttaca

SEQ ID NO: 56307 - DNA, 101 bp, rice(Oryza sativa)
  misc_feature (71): n=t or g
gcaaacattgcaccaaacgtcacagtcacaattagaaccgaaccaatgcctagtgtttgtgtcgattcttncatcttgtctaattcttcggccagatcctc

SEQ ID NO: 56308 - DNA, 101 bp, rice(Oryza sativa)
  misc_feature (71): n=t or c
cactttatgtagagttcttacgattttgctgctggtttcatggatcgtttcgaaccaatggttaccccaangatatccataaggtcgcaggcacatgtaca

SEQ ID NO: 56309 - DNA, 101 bp, rice(Oryza sativa)
  misc_feature (71): n=t or c
aagaagaaaacaaagagaagcactcttaggtgtactaatagcaaccgtacttgagagtgaggtagctagtnatgacaatccagctaccgtctcgtcgtaat

SEQ ID NO: 56310 - DNA, 101 bp, rice(Oryza sativa)
  misc_feature (71): n=a or g
tgccatgccagacatcgagccagaaggatgatcttctcccgtttctaattattactctggtgattcgcctntactcggggagcttgtctgcgatagatttc

SEQ ID NO: 56311 - DNA, 101 bp, rice(Oryza sativa)
  misc_feature (71): n=t or c
ataatgcgtcagggcacattgattggtcggtcattgcaattattatgctaattaaggtcatcgcaacctanatatatatatatatatatagggtaactccc

SEQ ID NO: 56312 - DNA, 101 bp, rice(Oryza sativa)
  misc_feature (71): n=t or c
atttagttattgtgagatttaactcatgatttgccgctaacaaaatgatacatatagtgagggctacaagnttcatattgtttatagatatataattgacg

SEQ ID NO: 56313 - DNA, 101 bp, rice(Oryza sativa)
  misc_feature (71): n=t or c
tagtcttgcagtagctcaatgtcacccaggtagtcttggtcttcgacagtcagtgtgattggcttaacatntgttccagatccatcaaattgaatgccccc

SEQ ID NO: 56314 - DNA, 101 bp, rice(Oryza sativa)
  misc_feature (71): n=t or c
ctggcaatggcaccacttccatgcaagttctcacaaccgagtccatcctcttttccaacaatggtatcaanaacccatctagtttctccactttctagttt

SEQ ID NO: 56315 - DNA, 101 bp, rice(Oryza sativa)
  misc_feature (71): n=a or c
taagtttgcatgaagtactcgaaatcttcaccttgaagctttgcaaatcctacgccacgattgcgaccagnagatgccataacagaaatagaggaagccat

SEQ ID NO: 56316 - DNA, 101 bp, rice(Oryza sativa)
  misc_feature (71): n=t or g
aaataagaagctgcacgtcgttagggatggcaaacgaagaattgttggggttgacaacgttgtcgatgagnaagaatataaccagaatcttcatgtgagac

SEQ ID NO: 56317 - DNA, 101 bp, rice(Oryza sativa)
  misc_feature (71): n=a or g
tgctgcgactttggactggtgcttctgacctccgcagtgatcacgtaggttgcgctcgctggttgttcgancctggcacacggcgcagctccatgccgagg

SEQ ID NO: 56318 - DNA, 101 bp, rice(Oryza sativa)
  misc_feature (71): n=t or c
tcctcatgcgcatgcaggcacgcagatatataacttagcattccttcgattaacccatccgtatatattgntttttttttatcttcctttctttctgaatc

SEQ ID NO: 56319 - DNA, 101 bp, rice(Oryza sativa)
  misc_feature (71): n=t or c
acgccaagtcggcaactgtgtctcgtgcgatctctagctctcaaatctcaccattttggctgcatttgctngcggatatgaatagtttgtcaaatttgata

SEQ ID NO: 56320 - DNA, 101 bp, rice(Oryza sativa)
  misc_feature (71): n=a or g
agataatataaataggtcatgtcaatcacaagactgtgtacgtgccgatggataaggtattggggcaattntaaatttaccactattttgaatcgttattg

SEQ ID NO: 56321 - DNA, 101 bp, rice(Oryza sativa)
  misc_feature (71): n=t or c
atacttttaatagtggctcccgtgccaaccacgactcagaatcaccatcaaccaaaaaaaaaatgaaaagnaccaacggccacgctacacctgtagtactc

SEQ ID NO: 56322 - DNA, 101 bp, rice(Oryza sativa)
  misc_feature (71): n=a or g
tgctccaggagagagccagccatgaccacaacaccagtggtaccatccccaatctcgtagtcttgactgcnggacagctccaccatcagcttcgcgatttg

SEQ ID NO: 56323 - DNA, 101 bp, rice(Oryza sativa)
  misc_feature (71): n=a or c
gtttggtatctctggtgacagcctgatgggctcactgtctagatttcctcgcagtattgagatattggatntgcaaacttgttgcctctcccgagttccca

SEQ ID NO: 56324 - DNA, 101 bp, rice(Oryza sativa)
  misc_feature (71): n=t or g
gtcttattcctgtgatgtattctatgatctctcagtgccattgccaccaaagggtgctccatccaatagtnttgcatcaccaccacagaatgaaagaccta

SEQ ID NO: 56325 - DNA, 101 bp, rice(Oryza sativa)
  misc_feature (71): n=t or c
gacaagactaaggacgatgatgacggtgatggtggtgacaacagaggtgggagatgtcggtggtggctatncagttcggctgtgccttagctttaatggtg

SEQ ID NO: 56326 - DNA, 101 bp, rice(Oryza sativa)
  misc_feature (71): n=t or c
ccttgagatctgacagatttcactgtcagcagattgcacaggttcaaataactcagcttcaggttcgatantcgagtccatgatgtgatcatccaacatct

SEQ ID NO: 56327 - DNA, 101 bp, rice(Oryza sativa)
  misc_feature (71): n=a or g
taaaaaacgtgtaattagccgtgggacaccgcaaaaatatgaattggctgtaagacgtcgcaaaagagtgntaattagcaactagacactagagacattat

SEQ ID NO: 56328 - DNA, 101 bp, rice(Oryza sativa)
  misc_feature (71): n=t or c
atatatgcaaatctaaacaacttctcttcagctctgaattttgactcatattgtcaggaacgtcctctgcnaactcagaagcgaaaactaattgattacta

SEQ ID NO: 56329 - DNA, 101 bp, rice(Oryza sativa)
  misc_feature (71): n=a or c
ccatccacgggctcaccaagtcaccaatcagtttgttcaccttgctgctctttttttgcatcttcctttgnatctgcgtttcagcacatgacaaagttaga

SEQ ID NO: 56330 - DNA, 101 bp, rice(Oryza sativa)
  misc_feature (71): n=t or c
tagctaggagtggtcattagtaccatagaagtagttccaagttccaaatcctgagcacgtactacgcttanattttgcatgagatttaactgaattcgctt

SEQ ID NO: 56331 - DNA, 101 bp, rice(Oryza sativa)
  misc_feature (71): n=t or c
ctagttgttttaaccccaacaagggagataaaaattaggcattcaaagcgatattccatatggtatgcttnatagcttcaagctagcaaatgatatgttgg

SEQ ID NO: 56332 - DNA, 101 bp, rice(Oryza sativa)
  misc_feature (71): n=a or g
gatattggcaatttcggttgaaaatttccgcacgatgaacattggacattgtgagtggacactgaacattntcatgatatccgcacaccacagacctctgc

SEQ ID NO: 56333 - DNA, 101 bp, rice(Oryza sativa)
  misc_feature (71): n=a or g
tgtccgcatcgtcgaaatagaatgaagaggatgaagaaagaggaaagtacttaccagaaaatttgccaccncgtcaagttctgatgcagctgagcagagcg

SEQ ID NO: 56334 - DNA, 101 bp, rice(Oryza sativa)
  misc_feature (71): n=t or c
agtgtacgtgccggtgacggcgacgaacactcctagcagcagaattccggcgatggccaccatctccgtgnggtggatgccatcggccttgtagatcttga

SEQ ID NO: 56335 - DNA, 101 bp, rice(Oryza sativa)
  misc_feature (71): n=a or c
tagcattatgacctgctatagagttctatgcagatctcaataggtttcccatacccccatcaatattctgnttccgtcggtgttgttgatcaatggttctc

SEQ ID NO: 56336 - DNA, 101 bp, rice(Oryza sativa)
  misc_feature (71): n=t or c
aggcgtgtgtttcgaaattaaacagtaaatgtgtgggacccatagaacgcaacaacaaagtacaaaagccnggtccatctcaaagtccacagccgtgcctg

SEQ ID NO: 56337 - DNA, 101 bp, rice(Oryza sativa)
  misc_feature (71): n=a or g
tggctgtgtgggtgctacgactagcggctggctaggtgctacaactggtggtggtgatggtgctatgaccngtgccggtgttggttctgcagtcaccgatg

SEQ ID NO: 56338 - DNA, 101 bp, rice(Oryza sativa)
  misc_feature (71): n=t or c
tctctccagcgatctctccaacacacaaggcgatcccaggcgatttcatttccgatcagatctccgcctanggtgatgtcgtcttccgctagcccgtctac

SEQ ID NO: 56339 - DNA, 101 bp, rice(Oryza sativa)
  misc_feature (71): n=a or g
ctgctttgatctgtttagtaaagtatttgttggcatcaggtacccaaaaatttagtgggaatggatggaantttcaatcaattggaacaaccatttgcagc

SEQ ID NO: 56340 - DNA, 101 bp, rice(Oryza sativa)
  misc_feature (71): n=a or c
gaacaattttcttcatgttcgaaagcaagcttcaaccccttcagttgtcttgctccatgagaagaataagnatggcgaaattatccatgcacaaggaaatg

SEQ ID NO: 56341 - DNA, 101 bp, rice(Oryza sativa)
  misc_feature (71): n=a or c
ctcctacgtcatatggagatgagcagattcgatatgatattctcgcacagctagctgcactcttgcagtcntgggccggggaatggtgcccgcctggtcgg

SEQ ID NO: 56342 - DNA, 101 bp, rice(Oryza sativa)
  misc_feature (71): n=a or g
caaatcacatgttaaaacaaatttctgcagctttgggaaattgtcggtatgggtgattcttcccaaacgcntggtaacgcgtttagtgatgatgttctcag

SEQ ID NO: 56343 - DNA, 101 bp, rice(Oryza sativa)
  misc_feature (71): n=t or c
accaagaagcccacccctttgacggccatcgacaggtaccctacaaacagagcatggttgttgatatattnaacttccagccactcagagtgatcaagccc

SEQ ID NO: 56344 - DNA, 101 bp, rice(Oryza sativa)
  misc_feature (71): n=a or g
gtgtttttttgttcttgtgttatttctttaatttttttctaagaaatttaggttcgcagcaggcggtgacnggaggagaggcggcagcggcgggcggccct

SEQ ID NO: 56345 - DNA, 101 bp, rice(Oryza sativa)
  misc_feature (71): n=t or c
ctccagctgaagcttccatcctggacatggatgattcccgcatccgaattcttcgtcgtcgtcgtcgtcgncgccgctctcgtcacgtcgtcctgtttgat

SEQ ID NO: 56346 - DNA, 101 bp, rice(Oryza sativa)
  misc_feature (71): n=a or g
tcaagtcgacctcactgccattagccatgtgcttcaattgaggtatttgagagtggagacgcctggttgtnagatagatctccccagcaaaatatgtgggc

SEQ ID NO: 56347 - DNA, 101 bp, rice(Oryza sativa)
  misc_feature (71): n=a or g
accatctttgcatacagaaggttcagccaaaattattttccaataacctcggcgaaagtaagctgctgagnagccaccatcagaaaaatcaaccactgcaa

SEQ ID NO: 56348 - DNA, 101 bp, rice(Oryza sativa)
  misc_feature (71): n=a or g
acacgcttcgtactctcatctcaaccttcagattcacatctgtgagataacaatggctagaagcaagtttnttgctcttagcttcgtcgtcctccttggca

SEQ ID NO: 56349 - DNA, 101 bp, rice(Oryza sativa)
  misc_feature (71): n=a or c
aggaggcaaccccgctgtctttgcttggtgaccgaggtgattaaaaggaagcaaaggcgccacagcgaagnaataatctattccaaacaatacacttgtag

SEQ ID NO: 56350 - DNA, 101 bp, rice(Oryza sativa)
  misc_feature (71): n=a or g
ggatacgaagcacggggagagggtagttttgtcttccttccgtggggccatgtttgtttttacagtagagnctaatgggagtaacaaaaaatttgagggtt

SEQ ID NO: 56351 - DNA, 101 bp, rice(Oryza sativa)
  misc_feature (71): n=a or g
tgtgcctgctggaaggtggttgactgggagttttaatcttatcagtcatctcactgtgtcacttgacgccnatgcagtaataatcggatctcaagtaagat

SEQ ID NO: 56352 - DNA, 101 bp, rice(Oryza sativa)
  misc_feature (71): n=a or c
ccctttttctgcagcttgtcgggtcaatcagcttcgtggttgatgaactgaaatcagttgacgaacagagntttcttgacggtgagatgtatgctagtccg

SEQ ID NO: 56353 - DNA, 101 bp, rice(Oryza sativa)
  misc_feature (71): n=t or c
attcattgcatagcacaagacattaacatcgcctcgatcttacgtcaagccctagcaccatctaatcttgngacaaccacatgggatcatcatctcctctt

SEQ ID NO: 56354 - DNA, 101 bp, rice(Oryza sativa)
  misc_feature (71): n=a or g
ctgcaacactgcatggggtttcaactagtacaagatataacgcatccctgatataacaaaactgagacacnttgggtcccaaggtagtattgagagtgctt

SEQ ID NO: 56355 - DNA, 101 bp, rice(Oryza sativa)
  misc_feature (71): n=a or c
actgccggaagatcgccggagaacaggacaagatgggaaagctagggtttttctacagaagcggagaagangagggatgtttgaaggctggaaagttttgc

SEQ ID NO: 56356 - DNA, 101 bp, rice(Oryza sativa)
  misc_feature (71): n=a or g
cgttgtgcccatccgcggtcaagagctttcgacgtctcgctagctagttcccagaccttttgatttttccnttctttccatctatggctcctcgcaaaccg

SEQ ID NO: 56357 - DNA, 101 bp, rice(Oryza sativa)
  misc_feature (71): n=a or g
atgaaaaggagagggtgcatcgaggaagacgaatgtgagaggaagaaaaggtgctttacctgtgagaagtngtggattggcgaataggagtataggactaa

SEQ ID NO: 56358 - DNA, 101 bp, rice(Oryza sativa)
  misc_feature (71): n=a or g
gtacaaacatgtcacgtcatcatccactagctataattgcatatcaaactcacaagcatgtaaaatcatcnacaatttattgagttctacaggtcatacat

SEQ ID NO: 56359 - DNA, 101 bp, rice(Oryza sativa)
  misc_feature (71): n=a or g
tgcgtccgcccaaaccttcatggagtggacccagcaagcgggtggcaagaggttcggcctgaatccagacnaacttctgaactactactgcggttattgtg

SEQ ID NO: 56360 - DNA, 101 bp, rice(Oryza sativa)
  misc_feature (71): n=t or c
aattgctacaatcaggaagcttcacgcaaagcatgccaatgatcaaacatgagcaacacatgttcagcgantgcatccctcaggcggacgcaagaggtagg

SEQ ID NO: 56361 - DNA, 101 bp, rice(Oryza sativa)
  misc_feature (71): n=t or g
taacaataaattaaatgcgaggaacatagattaagccgggccccctttcaacgccaaattaaactaaactncagttttgcgtgattcccgagatccgatct

SEQ ID NO: 56362 - DNA, 101 bp, rice(Oryza sativa)
  misc_feature (71): n=a or c
taactgagtaactgatacagtcatcctgatgtctctccaaaaatctatgaattttcttattcaagatgatntttttatcttgcttgcatctacatcaggtt

SEQ ID NO: 56363 - DNA, 101 bp, rice(Oryza sativa)
  misc_feature (71): n=t or c
gtctaaaaatataatataagccatgtgtaccaactagtcggtcgattcggcagtagagattaatattttcnattttactgtttactaaggttttgccccaa

SEQ ID NO: 56364 - DNA, 101 bp, rice(Oryza sativa)
  misc_feature (71): n=a or g
cttgcattgcaaaagaaacgatccagcttgaccagggtcgggttatcttgttcgttgctccaggtgtagcntctattctgaagtgcgatctccttgagttc

SEQ ID NO: 56365 - DNA, 101 bp, rice(Oryza sativa)
  misc_feature (71): n=t or c
gagctgggaactagacttcgtatagaaactgaaaaaggactcagccctgttctttttctccaactaacgtnaactttcttatttttcattagcatgttttt

SEQ ID NO: 56366 - DNA, 101 bp, rice(Oryza sativa)
  misc_feature (71): n=t or c
ggtacatactctgttgaaccctccatttactgaaatagttgctatggacggtccaccactattgtcatcanatttgtcatgaaacagcggtctgaagtcct

SEQ ID NO: 56367 - DNA, 101 bp, rice(Oryza sativa)
  misc_feature (71): n=t or c
aggtatattactagtgttatgaaaaagggaacataatttgtgtgttctcatgattggagcggttaatatgnatgtttggaatatttacttttcatctagat

SEQ ID NO: 56368 - DNA, 101 bp, rice(Oryza sativa)
  misc_feature (71): n=a or c
ccttaacctttaaggggagactcatgaaagaagaaaaagattctagactttatggcctttctgtcccctcnatttctgccattgtttggatgccatgggac

SEQ ID NO: 56369 - DNA, 101 bp, rice(Oryza sativa)
  misc_feature (71): n=a or g
gatcttacatcttgggttagtttgcttgagacgtatgctaatgagaggagtgctagccctgaagctgatgntgaggcatatgatgtgggtcttcttgatga

SEQ ID NO: 56370 - DNA, 101 bp, rice(Oryza sativa)
  misc_feature (71): n=t or c
gtgtgtatgtgtgttactaaggtgagtgtatgcacgtactccctctttccacaatctaggttggttttttntgatatggaagaaatgtgtttttagaaaaa

SEQ ID NO: 56371 - DNA, 101 bp, rice(Oryza sativa)
  misc_feature (71): n=a or c
ggcgaatctgatcaacaacacgctgacgaaaggctcggtgatggacgaagacagcagcctcaacgacgtgntgtcggaagtggatgcctactgcaagatgc

SEQ ID NO: 56372 - DNA, 101 bp, rice(Oryza sativa)
  misc_feature (71): n=a or g
aaagatcgtgcaaccttatatttgccagtcgaagcatcaaagcccaagttgtcacgttgcctcatgttgcnattgctctctggcagtgcaaggacatccct

SEQ ID NO: 56373 - DNA, 101 bp, rice(Oryza sativa)
  misc_feature (71): n=a or g
gctcaaggacccattcctgcaggttgacgatttggtcttttgtccgggtgatggagattacagcctgatgnactatctgcggcagccttatttagaacacg

SEQ ID NO: 56374 - DNA, 101 bp, rice(Oryza sativa)
  misc_feature (71): n=t or g
tgacagagctcctgatctggatgttgttattgacttcttaaaatgctttccgtgcgtggagaagctatacnttgtggtgagagttttttctttgttaaatt

SEQ ID NO: 56375 - DNA, 101 bp, rice(Oryza sativa)
  misc_feature (71): n=a or g
attcgcgatcacacggctctaatggctgccccacaggccaacatcaaacctagcgtccctgtagtttccgnggctcgccgggcgaagaacaaggagtggag

SEQ ID NO: 56376 - DNA, 101 bp, rice(Oryza sativa)
  misc_feature (71): n=t or g
tgaggctggaacatgctgggaagatccagtcagcctcactaatatcagcagcagaagaggaggaagaacangacccggagtcagcctcactaatatcagaa

SEQ ID NO: 56377 - DNA, 101 bp, rice(Oryza sativa)
  misc_feature (71): n=a or g
tttattggaatagtcttctgttttgcttaggattttcctgtcgtaattttccctaatcttcttatttagtnctacatggtaatctactgtgcacatattgt

SEQ ID NO: 56378 - DNA, 101 bp, rice(Oryza sativa)
  misc_feature (71): n=a or g
tttacacttttcattgaaatgcatgcatgattcttcattgctactactcctccattattatttattgatcncagctatatataaaccaattgaattgttag

SEQ ID NO: 56379 - DNA, 101 bp, rice(Oryza sativa)
  misc_feature (71): n=a or g
cgatcgccccgcccataggagtttcgtttcccacaaggccacgagcccacgaccactcgtttcctaggccnagttcagttccaaactttttcttcaaactt

SEQ ID NO: 56380 - DNA, 101 bp, rice(Oryza sativa)
  misc_feature (71): n=a or g
agataaaatcaattttctttctgaacttgaagctctgcagacctctatgaaatctgcttggctcattattngagatttcaacctaatatataaagcttcag

SEQ ID NO: 56381 - DNA, 101 bp, rice(Oryza sativa)
  misc_feature (71): n=a or g
tttgctccggttttttaagacggaggagatgttacaccggtattgcggttaagggagaggcgattaaatcnagggatacaagttgagagacacaaaataga

SEQ ID NO: 56382 - DNA, 101 bp, rice(Oryza sativa)
  misc_feature (71): n=a or g
ccctgagactatcggggagcttattcttcttcatgggctcaacatgtctcacaatgcccttacaggatcanttccaactcagtttggcagattgaatcaac

SEQ ID NO: 56383 - DNA, 101 bp, rice(Oryza sativa)
  misc_feature (71): n=a or c
aaggtgccggccgaccattcgccactcggagaaaacaagcacaccaatttcttttatttctcgggttaagngggagcaactctctaacagcgtagtccaca

SEQ ID NO: 56384 - DNA, 101 bp, rice(Oryza sativa)
  misc_feature (71): n=a or g
atacaagaactgccacggagcatctgtcgcctaagaaaactgatgtgcctttgtgttgacagcactgcaanattgcctagtgggattgggaacctagtggc

SEQ ID NO: 56385 - DNA, 101 bp, rice(Oryza sativa)
  misc_feature (71): n=a or g
attgggaggggtctactaggagctggcgccatctatggaggagcttaatggagattgagcagcagccatcncctccagatgcggctgacgatgctccttct

SEQ ID NO: 56386 - DNA, 101 bp, rice(Oryza sativa)
  misc_feature (71): n=a or g
ttacggtcctggagacattatcctgagctcaaattcagtgccaaaacattatccatggatggacaacacanttgtatacaaggtcaaatggattcatatat

SEQ ID NO: 56387 - DNA, 101 bp, rice(Oryza sativa)
  misc_feature (71): n=a or g
agagctgcctgtgtcgatcaggaggtattgcttctgttgccgctcaccaatctccatttcagcaagatagncaacatcctcataaattctaaatggagtca

SEQ ID NO: 56388 - DNA, 101 bp, rice(Oryza sativa)
  misc_feature (71): n=t or c
acctccgacaacctctttctctgcaagatgcatgtgcatggaaattatatacttcatccatctcaaaatanggcaatttaaaaatggataagacaaaaata

SEQ ID NO: 56389 - DNA, 101 bp, rice(Oryza sativa)
  misc_feature (71): n=a or g
ttaaccggttgtagctaagaacaattaaaaaaactaaaacataccgctcgaagatgagtgcaaagggaagnatgaagatggcaccgaatacgctgcggtac

SEQ ID NO: 56390 - DNA, 101 bp, rice(Oryza sativa)
  misc_feature (71): n=a or g
aaagttcctgtgtgctatcaggaaagtataatgcagtggcagtattcataacgtatccagacattaagcangggcaaccataaaataaattcggatggtaa

SEQ ID NO: 56391 - DNA, 101 bp, rice(Oryza sativa)
  misc_feature (71): n=t or c
tcatttgtttgatcattcgtcttatataggaatttataaatatgcaaatatctttaaccataaagcaagtnataacaaaataagtgaacgtaattttctga

SEQ ID NO: 56392 - DNA, 101 bp, rice(Oryza sativa)
  misc_feature (71): n=a or g
cctggttgatggcatatggaacatttgtttgtgtctgtcatgtgcttgtatctttgtagcctttatccatntcatttttaaacgtttttgtccttcgtctt

SEQ ID NO: 56393 - DNA, 101 bp, rice(Oryza sativa)
  misc_feature (71): n=a or g
agaataccttctgtttttgcctgactcgaaagagaattgaaatgtttcgcgctggtaatttactgtatatntaataataataatattatcccctctctcac

SEQ ID NO: 56394 - DNA, 101 bp, rice(Oryza sativa)
  misc_feature (71): n=t or c
gatgggttgatgcaaccacacaaaccatgcaaatatgctgcttccaagcaaccccttttgcagtttccatntcaatctctttttgtacagtactaccttac

SEQ ID NO: 56395 - DNA, 101 bp, rice(Oryza sativa)
  misc_feature (71): n=t or g
ataaaggctaataaatgagggttactggtggagttaaagtcattatttggggtctcaagaaatagaggtgncccctattcaacctttgagtactttaaaat

SEQ ID NO: 56396 - DNA, 101 bp, rice(Oryza sativa)
  misc_feature (71): n=a or g
gcaatggcgtgatcgagctcagctcaccatgccgatggagcagaaggaggaggtgctgctctgggagaagnaggtgtggtcgttgccgccgaaggagtctc

SEQ ID NO: 56397 - DNA, 101 bp, rice(Oryza sativa)
  misc_feature (71): n=a or g
tgtctaggtatccttcttctgccactttagaattgtctgccttgtctgttgctttgcctgattggattcangaggtggtgtctggttactcgcttgatcct

SEQ ID NO: 56398 - DNA, 101 bp, rice(Oryza sativa)
  misc_feature (71): n=a or g
attttggtctgtgatatgcaaggatataaagcctacctgtgataaaagaaagaacgggagcataatctaancaggatggggatccagttgcatcaaacttc

SEQ ID NO: 56399 - DNA, 101 bp, rice(Oryza sativa)
  misc_feature (71): n=a or g
tttatgtttttactgttttgatgcatgatgtgatcatgccgataatctgacatacagatttgctttaggcncctagaagctaattccgttgggatggcaga

SEQ ID NO: 56400 - DNA, 101 bp, rice(Oryza sativa)
  misc_feature (71): n=t or g
aaatctctgcatttagcacataccggcacaactgattcaatcttgacactggatgacattttcttgaggcnctcatagagcttcccgacgtcgacagtccc

SEQ ID NO: 56401 - DNA, 101 bp, rice(Oryza sativa)
  misc_feature (71): n=a or g
gtgaggatggactttgcctccaaaagaaaaagaggtaactttgagtgaaaattgagttgaccttctggtcncttggtgaggcaaggggttaacagggctct

SEQ ID NO: 56402 - DNA, 101 bp, rice(Oryza sativa)
  misc_feature (71): n=t or c
agatattgtagagtgtaatcaaattatgtcttctccagttgcatctgaggtttcatgtgttgtcagtctgncagatcatcagtatcagaatctgcacatga

SEQ ID NO: 56403 - DNA, 101 bp, rice(Oryza sativa)
  misc_feature (71): n=t or c
tgatggcttctgcaattgatttgtttcgtttcagaactcaagtcctgacaagtccaagcacggcgagatancactgaagggccgggggctttgtctggtgc

SEQ ID NO: 56404 - DNA, 101 bp, rice(Oryza sativa)
  misc_feature (71): n=a or g
gacgacgacgaggtaacaagtggcacaaagatagagcacaattctatcgggaggttgttaggcgcatcagntttctcgagccgccggggccggggttacct

SEQ ID NO: 56405 - DNA, 101 bp, rice(Oryza sativa)
  misc_feature (71): n=t or c
tgaaagctgggggcgagcaagccctacatttttagcttttaaccttatggctccagcaatttcgattgacngtaattttgtttagtttggtatatgtcctg

SEQ ID NO: 56406 - DNA, 101 bp, rice(Oryza sativa)
  misc_feature (71): n=t or c
cgcgtgaaaacgaggatggtgagttgggaccaaggggaaacgaactatggagtttggaaacttcaccttcncacacgtaaaatgaaatgattcattaatta

SEQ ID NO: 56407 - DNA, 101 bp, rice(Oryza sativa)
  misc_feature (71): n=t or c
ggcaacccccatgagcttcaattcaacctctccacctcctctaagccgcagcccggtgacttctcatcctntgctccttactacccctgcccctgccttgg

SEQ ID NO: 56408 - DNA, 101 bp, rice(Oryza sativa)
  misc_feature (71): n=a or g
ggtgtatgaagtagctatagcctagagctatctcatttctaccacaccaattttgacaatttaaccctgtncaaaaactatttttacaaatgaaccgctgc

SEQ ID NO: 56409 - DNA, 101 bp, rice(Oryza sativa)
  misc_feature (71): n=a or g
accatcccaaacaacttattaagcacatgtcgacggctttaaataaataggcgaactttcccatctatgtncatgccatatttttcctagatcagagattt

SEQ ID NO: 56410 - DNA, 101 bp, rice(Oryza sativa)
  misc_feature (71): n=a or g
ttgcaaaaccatcatctcatctcagtttcagattcccctctaagctataaatacctcctcattcatcttanttttgagatttatccccaatcaattttgct

SEQ ID NO: 56411 - DNA, 101 bp, rice(Oryza sativa)
  misc_feature (71): n=a or g
tatctcaaatattttttttcttgtgctgccagtgaaaaaagaaaacattgaaaacgttgttttgccaagtnctaactgtgaaaattctagattaccatatc

SEQ ID NO: 56412 - DNA, 101 bp, rice(Oryza sativa)
  misc_feature (71): n=a or g
cttgagaaaatggagggaattgttgttactagtatacagcaagcaatgattggattggatgctgacgatgnaacgaaccgctcctcctaatacatgatttg

SEQ ID NO: 56413 - DNA, 101 bp, rice(Oryza sativa)
  misc_feature (71): n=a or g
ttcatcctatcccataaagacaaccacgaacacgtgtagtgtacccccacactattactattaccccaagnttctaaatagcgggctaagacatttaacgg

SEQ ID NO: 56414 - DNA, 101 bp, rice(Oryza sativa)
  misc_feature (71): n=t or g
ctggggatgtatcattccaggttaacagtgtgatttccatgagtgttcttggggaacctcttatgctaatntccccaggaccagcagattctcctggttct

SEQ ID NO: 56415 - DNA, 101 bp, rice(Oryza sativa)
  misc_feature (71): n=t or g
tttaagtttgactaagtttatagacaaatataataatatttggcgatgaccaccgccgcttccgagagacnaaagccaccttcgaccacctcgagcaaaag

SEQ ID NO: 56416 - DNA, 101 bp, rice(Oryza sativa)
  misc_feature (71): n=t or c
tctccaccagtcaaccggatcttatccacaccagaagtaacaaaaagatcggcaactcgaatgatctcgtngtgcgacaggagctctgagcttggcgtgag

SEQ ID NO: 56417 - DNA, 101 bp, rice(Oryza sativa)
  misc_feature (71): n=t or c
aaggcaaacactggaattgaaacccatgaaaagaacataatcttccagtgaatccatcttgacaagtttcngaccatcgatatcgaccttgaacagcagta

SEQ ID NO: 56418 - DNA, 101 bp, rice(Oryza sativa)
  misc_feature (71): n=a or g
ttgcattattgcaccgaattaggtgattgcacctgatacttccccagaagggtactatccgtcggaatcgnaaaacggtcggaactctccggaaatttttc

SEQ ID NO: 56419 - DNA, 101 bp, rice(Oryza sativa)
  misc_feature (71): n=t or c
caatacctataaagtggatcaggatgaaaaaaaaaagtccctagacacataagtccacaaatagacctcangtacccgacaaattaaaagtgtgcatggat

SEQ ID NO: 56420 - DNA, 101 bp, rice(Oryza sativa)
  misc_feature (71): n=a or g
cctacgtggcggtattgaccgggtctccttcacacgtagcgttgaggtgacatttagaatttaaaaatatntgtgggacccatttgtcattggcagaaaag

SEQ ID NO: 56421 - DNA, 101 bp, rice(Oryza sativa)
  misc_feature (71): n=a or g
actacatcaagattcgtgctagtaaccttagccttcctcttcccattcttcctccctgcctcttggcctcnccagcgttggaaggtgccaacagcgctagc

SEQ ID NO: 56422 - DNA, 101 bp, rice(Oryza sativa)
  misc_feature (71): n=t or c
gcaaagaaaagaatgatctttttaagcgcttgaagttcagtctcatttggtgccacaaagagagcaacatnatcagcataaagtgaacagcggaatcttct

SEQ ID NO: 56423 - DNA, 101 bp, rice(Oryza sativa)
  misc_feature (71): n=a or g
acgtgtatagcgctcggcttttgtattccgatgaaatctcgtgcttctctccggttgctatgtacgcgtcntcggagatgtaggaaatgttcgtgcgatcg

SEQ ID NO: 56424 - DNA, 101 bp, rice(Oryza sativa)
  misc_feature (71): n=a or g
cgcgatgttaaagtgcctataggtttctcatcgaacattaggctactagtctccataaaaaaaatttatcngtatccggttataattcacatgactgtcat

SEQ ID NO: 56425 - DNA, 101 bp, rice(Oryza sativa)
  misc_feature (71): n=a or g
ctgtgaagggaccaggtgtactaacttcttgatttgtttgcagtctcccgttgttgctaagggtgcaaatnctcttgcatggataaaggtacaattgaaca

SEQ ID NO: 56426 - DNA, 101 bp, rice(Oryza sativa)
  misc_feature (71): n=a or g
aaaacgatggattaaaacctgacgtctacctccaaacatagtaaaaaaagccggaccggtaagtgacccgnccgacctctcggttcagcggtccgccggtc

SEQ ID NO: 56427 - DNA, 101 bp, rice(Oryza sativa)
  misc_feature (71): n=a or g
ccgaggagcaagaagcagattgaggaatggagactggagagcagcggagtcgtcgacgactaggagcaggnactagggactgggaaggacaaaaaaaagac

SEQ ID NO: 56428 - DNA, 101 bp, rice(Oryza sativa)
  misc_feature (71): n=a or g
aagctgtggagggcttgtcaaatagattaaataaataggtgtatcgaatagatgaataagcaggtgtatcnaatagatgcacctaataggtgtagccctga

SEQ ID NO: 56429 - DNA, 101 bp, rice(Oryza sativa)
  misc_feature (71): n=a or c
cactagtagagacactcgcccagagcctgagctcgaaatgctgcttaaccttggcatcatcatagactaanttggcgagtgtggtcttccccacgcccccc

SEQ ID NO: 56430 - DNA, 101 bp, rice(Oryza sativa)
  misc_feature (71): n=a or g
ggtactgctgctgctgctatccatactagcgctagtcctaacgcatcagtgctcttattaaggatggtgcngcattatgggcgggatcgcgaccggtcggg

SEQ ID NO: 56431 - DNA, 101 bp, rice(Oryza sativa)
  misc_feature (71): n=t or c
cattgtttggtatggctagctgccaacaatgctgaggtatcggcagctgttataggtgggttcatttcagntgagataccagactttcgaatcgatgaatt

SEQ ID NO: 56432 - DNA, 101 bp, rice(Oryza sativa)
  misc_feature (71): n=t or c
ccgcttcgacgccgccaccacaacctcctctctctctcgctgctgcagtcgcttcctgctgctattgctanttcgtctccacatcctcctttccctcctcc

SEQ ID NO: 56433 - DNA, 101 bp, rice(Oryza sativa)
  misc_feature (71): n=a or c
ttttcatcactgaggggctccattctgtaaatgaatcgtcgatgattgcagcatacccatctagcaacatnttccgatcgtgtggtcacaattattctaca

SEQ ID NO: 56434 - DNA, 101 bp, rice(Oryza sativa)
  misc_feature (71): n=t or c
tctgcaagtgatcgtcggcgaccccctcgggatcaagctggtgtcttcaccgctacgactatttcccctanactgacaatacatgaggtggttcgaggttc

SEQ ID NO: 56435 - DNA, 101 bp, rice(Oryza sativa)
  misc_feature (71): n=t or c
gtagtagttggctatactattaaacttgctctaaatgtgtagttgctatcatccgctctcataatggctantactaggtattaaggtatcatttattgatt

SEQ ID NO: 56436 - DNA, 101 bp, rice(Oryza sativa)
  misc_feature (71): n=t or c
aacaacggtatggttttgatgagatcatgggtcatgttgacaatggtgttggaaatgtcttcttcattganggaccaggaggaacgggcaagacttacctg

SEQ ID NO: 56437 - DNA, 101 bp, rice(Oryza sativa)
  misc_feature (71): n=a or c
ttttgcagggtttacgatacgaagtatctgcactagtcatccatttttttgctttgttgatcgatcgatgnagctctcgcatggtacacgcgtctctcgat

SEQ ID NO: 56438 - DNA, 101 bp, rice(Oryza sativa)
  misc_feature (71): n=a or g
aaaaatatagtatatttaaaattcagataacacatgtacaaacggcctgatcagccatcagataacacatntacagagttaaagagtgtttgtttgagccg

SEQ ID NO: 56439 - DNA, 101 bp, rice(Oryza sativa)
  misc_feature (71): n=t or c
tggtgaccacgctggctctggctgctttacgattcgctcgctcgccaccaatgatccatccatctctcgancgatcgcctgcacgcgctaccaaagcgagg

SEQ ID NO: 56440 - DNA, 101 bp, rice(Oryza sativa)
  misc_feature (71): n=t or g
agttgaccgagaactgtgacatcgcggtagctcctctgcgcctggaaagcatcaccgtgaaacatggcgangttgtcgactgccttagcttctcctacagg

SEQ ID NO: 56441 - DNA, 101 bp, rice(Oryza sativa)
  misc_feature (71): n=a or g
tttttatgagcttaatattatgtgaaaggtatgaaaaagtgttagctgacagtggcggacgcaggatttcnatgatgggggtacagacctaccaaagcatc

SEQ ID NO: 56442 - DNA, 101 bp, rice(Oryza sativa)
  misc_feature (71): n=a or g
ttgtgtaacttgtgtttgcatgcttatggttctatacttctctataattttatatattatgcggtgtttgnaaaggagggattaaactcacaaaaatttta

SEQ ID NO: 56443 - DNA, 101 bp, rice(Oryza sativa)
  misc_feature (71): n=t or c
ttgagcaaactgctggaacacatcttcaaggaatgggtgcgtctcctgattaactcgtccgtcaaatgtangagagattcgcatgccaagcagctgagccg

SEQ ID NO: 56444 - DNA, 101 bp, rice(Oryza sativa)
  misc_feature (71): n=t or c
gtgcggcggcctcgcgctgaaggtgcttggatggtgatgcctgctattaatggtagggacgtaatcataanagtgggccgacgatttcaagcgaaaaccca

SEQ ID NO: 56445 - DNA, 101 bp, rice(Oryza sativa)
  misc_feature (71): n=a or g
tccaacgtcgttgggaacaccaaggctcgacgccgacacataaaattcaatctccatgagcattggcatcnctccctgcagaaacttgagctctatgttca

SEQ ID NO: 56446 - DNA, 101 bp, rice(Oryza sativa)
  misc_feature (71): n=t or c
gggagtgattggctgtctctctctgtgtccatttgctttactaaaatctaaatttgggaggaggagacttnacttctttcaggtcaaccccctgtcgcctc

SEQ ID NO: 56447 - DNA, 101 bp, rice(Oryza sativa)
  misc_feature (71): n=t or g
taagtgtgtgtgctaaatttagtgcgtttgtttatgctcttttgaactgaacaaaggaatgatcccggttngattgatgaatgctgcaagaacataatcta

SEQ ID NO: 56448 - DNA, 101 bp, rice(Oryza sativa)
  misc_feature (71): n=a or g
tccaggattaattagcggactgacgtacgtacttggacaaacatgccagtcaaactgcatcttgggacttngttaatttgcagattagcaagataagtgtg

SEQ ID NO: 56449 - DNA, 101 bp, rice(Oryza sativa)
  misc_feature (71): n=a or c
ctggttagaaggaatgtttccatcattttctgtaactggtagtcgttgataagagttgttcaagaaggggnatgaaaaccgcgagagcagtgatgtcatcg

SEQ ID NO: 56450 - DNA, 101 bp, rice(Oryza sativa)
  misc_feature (71): n=t or g
tttttatctcccaattcgacataaaagaaactgaactacatttttatctcccgatccagctgcaacgcacngtgcgttgcacgtaactagtcatggtctca

SEQ ID NO: 56451 - DNA, 101 bp, rice(Oryza sativa)
  misc_feature (71): n=t or c
ttctctcttctcctcttccacacgttcttctgtcttctccttttcccattcttctttagagaaatatggtntcttccccgtcaatacctccagcatcacaa

SEQ ID NO: 56452 - DNA, 101 bp, rice(Oryza sativa)
  misc_feature (71): n=t or g
tccacctgacgatgctgacaaagaagaggttatcaatgcattagttgctaatgttgaatcgatgattaaancagacaggaagattacgtcgttgaaacaac

SEQ ID NO: 56453 - DNA, 101 bp, rice(Oryza sativa)
  misc_feature (71): n=a or g
gtgaagtgaagcccacttagctagcttgcaattgagatcttgcagagaattgtgaagatctagagctatanccatggctctgcaagtgcaaggccttgtgg

SEQ ID NO: 56454 - DNA, 101 bp, rice(Oryza sativa)
  misc_feature (71): n=a or g
gtaatatctggttacgtcattctgggaatttacacgtatttttcgaagctttaggttgtgtctagattagnggtgaaaagtttttgcgtgtcacatcggat

SEQ ID NO: 56455 - DNA, 101 bp, rice(Oryza sativa)
  misc_feature (71): n=a or g
agcttattggtgcctatctgaatgtgaggctgtgagcccaagtctacaaacctttgttcattatgtcaccnaattaactttgttactagcaatccacaggc

SEQ ID NO: 56456 - DNA, 101 bp, rice(Oryza sativa)
  misc_feature (71): n=a or c
ggggtgtagctagacataaacagattaaggaaaagtgcagaaatgtgtctagctagccttattaaactatntatgagaatttacaaggacattaaactatc

SEQ ID NO: 56457 - DNA, 101 bp, rice(Oryza sativa)
  misc_feature (71): n=a or g
cagaatataagacgtaatgaaatatatcaattgtacacaaataagaattagtacaatttcatccccctcantcttcagttacccaaaaataaaaaactgat

SEQ ID NO: 56458 - DNA, 101 bp, rice(Oryza sativa)
  misc_feature (71): n=a or g
gagagtactactttgctagatcgttatgtcgagttgggaactcatttctccgcacggaaaatggagtaacncattttcttatgattaattaagtatttact

SEQ ID NO: 56459 - DNA, 101 bp, rice(Oryza sativa)
  misc_feature (71): n=t or c
ttttgttaaatcggtactggcgactacggttcaattgcacatatatccttagtgattaataaatatactcnatccgtcttaaaatagaaaaacttctaacc

SEQ ID NO: 56460 - DNA, 101 bp, rice(Oryza sativa)
  misc_feature (71): n=t or c
ggcatggcctagttagacgtatagagaaagaagatgagaatggagggaaaagaggggtaactttggaagtncatgtgttgggtatgttgtgccaaaagaga

SEQ ID NO: 56461 - DNA, 101 bp, rice(Oryza sativa)
  misc_feature (71): n=t or c
gagttatgtccgttgtccgttgtctctagttgaccgttacaagaggacatctcattatgttcttttttttnccctcaaatctgatcaacttttttactcat

SEQ ID NO: 56462 - DNA, 101 bp, rice(Oryza sativa)
  misc_feature (71): n=t or c
agcttggtatatacgtacgtacaggtagacgatggatggatcgatcggtttgcgccattttcactcacagngcgatcgccggtttcaaggtgtgaaacgta

SEQ ID NO: 56463 - DNA, 101 bp, rice(Oryza sativa)
  misc_feature (71): n=t or c
gttaattgtattcatgatcatttttcaagttgttacactaggggcaaaaaaattgttgtaacatgatttcngagcgattctactagtcaaacatattcaat

SEQ ID NO: 56464 - DNA, 101 bp, rice(Oryza sativa)
  misc_feature (71): n=a or g
tcgcttcagttcccgggggaaaatcttcaagtgtgcgccacggcatgaagtcagggtcgcgcgcttgatgncttgcaagaaccagctccaccgcggcccgt

SEQ ID NO: 56465 - DNA, 101 bp, rice(Oryza sativa)
  misc_feature (71): n=a or c
gaggagttgggaagacatagcaactagcacagccataatttcttttccaacagagagtggcatgcttgttntatggtagcaccttacatgcaggtttctca

SEQ ID NO: 56466 - DNA, 101 bp, rice(Oryza sativa)
  misc_feature (71): n=t or g
cccctctgtccttaaagaaagtttaatcatatctataaacatgaacaattatatgtctagaaagtgtgganatgaaaactatcctaggcattagtgtaaaa

SEQ ID NO: 56467 - DNA, 101 bp, rice(Oryza sativa)
  misc_feature (71): n=t or c
gtggtctgactggcgtacatggccagtctgaccggtggcatatgggtagtctgaccggccccctggtagcngggatggtgtgctctgggatggccaatata

SEQ ID NO: 56468 - DNA, 101 bp, rice(Oryza sativa)
  misc_feature (71): n=t or g
catggtggacgacggagtggagagcgaagaagaggaagaggacgctcccgtacgcgtctcggcccacacgnaatccggcgcggctgcgtccataccggccc

SEQ ID NO: 56469 - DNA, 101 bp, rice(Oryza sativa)
  misc_feature (71): n=a or g
tttggagaatctctactcccttcggcatgcaaccatttattcctttgatgatgacagcaaggctgttattnaagaggcacttaaggactatcctaatcaag

SEQ ID NO: 56470 - DNA, 101 bp, rice(Oryza sativa)
  misc_feature (71): n=t or c
ggacaacctttacctgtacagaaaaataaaaaacactaagcacatcgtacctttgcaatggcatcaacagnacattcttcacgccattttagcatatttaa

SEQ ID NO: 56471 - DNA, 101 bp, rice(Oryza sativa)
  misc_feature (71): n=a or c
tgatatgcttgaatttgtgaccttgttgatcgaggagcagaaaggaaggctttttagttggccgaaggagnaaaacttggctgcctagctctcatcgaact

SEQ ID NO: 56472 - DNA, 101 bp, rice(Oryza sativa)
  misc_feature (71): n=a or g
aggaaaaacaaccacaaatccacgtaaaaaagctggaatacatgagtgggaactgaagatccccttcatcncggcaccttttctatacactgatgtaataa

SEQ ID NO: 56473 - DNA, 101 bp, rice(Oryza sativa)
  misc_feature (71): n=a or c
ttcttgcttcaacaatgagcatcaaaccacaaccatgtccaatccgaggggtatgacacaactagaacacngttattatacattaaagaagcaagcacatt

SEQ ID NO: 56474 - DNA, 101 bp, rice(Oryza sativa)
  misc_feature (71): n=t or c
caactttatattcttgtctaacatcggtttagaaattttatttcttcgaaacccttatctacccatctacnaatacaacttttgtattaattaaagatatt

SEQ ID NO: 56475 - DNA, 101 bp, rice(Oryza sativa)
  misc_feature (71): n=a or c
attaaatgatttttaatccccgaaagaaaatcggggcgtgacatcggcgttggggcttgccagtgaaaacnagggttcaaaaaccgatggaatttcacgaa

SEQ ID NO: 56476 - DNA, 101 bp, rice(Oryza sativa)
  misc_feature (71): n=a or g
gatgatccatgtactcgtgcacgtatcaaattgatggcataccatacagaggaacccatatcacaagagtncatcgagtcttctcatggcttattgatacc

SEQ ID NO: 56477 - DNA, 101 bp, rice(Oryza sativa)
  misc_feature (71): n=a or g
atgacttcatgcatgtaaggtctcaggatttttctgcttaaatgcctctgcagggatgattgtgaagctanataagaaaagagtttaataaccatgaccaa

SEQ ID NO: 56478 - DNA, 101 bp, rice(Oryza sativa)
  misc_feature (71): n=t or c
gagcctacctatgatcttcttctctctattgttcgaaggttagggtgagctacacctgcaagaacggcaanaagagcgtgcagcagaacggggtaaacagc

SEQ ID NO: 56479 - DNA, 101 bp, rice(Oryza sativa)
  misc_feature (71): n=a or g
agttcactttaggtccttcattttgacatccaatttgaattgcatacctaaaccgttaaaccataaaactngatacaatgcattcctccaaaactactgag

SEQ ID NO: 56480 - DNA, 101 bp, rice(Oryza sativa)
  misc_feature (71): n=a or g
ctgaattttttgttccctccctctctctcctcaaaaatttcctctttcttcccaaatccctagcacagcancgaccacggcgaggacgtgcggtgcagtcc

SEQ ID NO: 56481 - DNA, 101 bp, rice(Oryza sativa)
  misc_feature (71): n=t or c
tgggccgtcaccatcgcatagaagacaatgagagatggtaccaggttagtctcttcgtcttctttgttgtncttatgtagtgccataaggtgtgacagtgc

SEQ ID NO: 56482 - DNA, 101 bp, rice(Oryza sativa)
  misc_feature (71): n=a or g
aaaatgtggttgcagggtgtgattgtcactgcactttcatactacatgcaaatatggacgatcgcgaaganggggccagtgttccttgccatgtcgatgcc

SEQ ID NO: 56483 - DNA, 101 bp, rice(Oryza sativa)
  misc_feature (71): n=t or c
atgggtcttttcaactcatgtaagaactttaaaccctgacatatcccttcaataattttgaagcgcatgtnccattttaattcattggattcacctgtaga

SEQ ID NO: 56484 - DNA, 101 bp, rice(Oryza sativa)
  misc_feature (71): n=t or c
atatgggccaagcccatactctgttcgttcttctctccctccctgttcgttcttctcttcctcacgaccantggcggcagcggcacggatctgcgaggccg

SEQ ID NO: 56485 - DNA, 101 bp, rice(Oryza sativa)
  misc_feature (71): n=a or g
acaaatcaagaatattctgctaaagactgtcaacaagatggggataggatggaaggacaaattatctgacnctctatgggcttaccgcacagcctataaga

SEQ ID NO: 56486 - DNA, 101 bp, rice(Oryza sativa)
  misc_feature (71): n=a or g
gttgcagggcccttttacgaacccttttgttgtcttttggaactttcttattcttagggcacccgcaatgnttatctataggctctctacaagagatccat

SEQ ID NO: 56487 - DNA, 101 bp, rice(Oryza sativa)
  misc_feature (71): n=t or g
ttatggaccaatgcccccagtataggcaacgacttcaggactacatcaaatgaattaagaatagagcacanaagcataaaatcggattcataatgtttcat

SEQ ID NO: 56488 - DNA, 101 bp, rice(Oryza sativa)
  misc_feature (71): n=t or c
tttctgttgtggttcctgatacataatttcttacaatgtcgtgagcagggatctaacaaatgcagatgaancattggtttcaaaagaaggcagaacaaaaa

SEQ ID NO: 56489 - DNA, 101 bp, rice(Oryza sativa)
  misc_feature (71): n=a or g
atatgcatatggtaaatagaacactgttaaaacctgcaaattacaccccaagttgaaacagcagccgagtnacagtgacagacagcgtgaactacgaggca

SEQ ID NO: 56490 - DNA, 101 bp, rice(Oryza sativa)
  misc_feature (71): n=t or c
ccaccctaatgcattcactcactcactggatacaaaagactagagacatgatgaaaaactgtccttcaggntaagagttttgagtcaaataactgttgtgt

SEQ ID NO: 56491 - DNA, 101 bp, rice(Oryza sativa)
  misc_feature (71): n=t or c
aatcaagctcaagctgcattgctggtaagccaggtgaacaatgtggaagagttcattgacaccctctcgantccgcttcagccgccgctcctgcctgctct

SEQ ID NO: 56492 - DNA, 101 bp, rice(Oryza sativa)
  misc_feature (71): n=a or g
gaggtacttgtacgacgtgttgttgatacatataagacatccaaacttcccctcaagctgacctgagagcnaaaagttcgccggtaggtcgttgatggtaa

SEQ ID NO: 56493 - DNA, 101 bp, rice(Oryza sativa)
  misc_feature (71): n=a or c
tcagattattcatttttcattcccaacgcgcaattatcaacatctcttggagctcatctgtcaagcaaatnaaaggagtcggttaacatttcatcattcaa

SEQ ID NO: 56494 - DNA, 101 bp, rice(Oryza sativa)
  misc_feature (71): n=a or g
tggcaattgaaggtgatatactttgcccgtagaccatctcgtaggcaaaagccacaacatccggaaatgcnacaggattcctgcgacctcaattcataaaa

SEQ ID NO: 56495 - DNA, 101 bp, rice(Oryza sativa)
  misc_feature (71): n=t or c
actcctcgattttatgtgcctatgatggttaagtttcgcaattggacatgtgagtgggatggagactttgngagggtttcctcatttagagggacatcaag

SEQ ID NO: 56496 - DNA, 101 bp, rice(Oryza sativa)
  misc_feature (71): n=t or c
cgccatcagtaccccgaatcgggtacgcacttcgcaacgcgcggccatctcttctctattactactcttcnctgcgtgtgaatctgaacaggacgagttac

SEQ ID NO: 56497 - DNA, 101 bp, rice(Oryza sativa)
  misc_feature (71): n=t or c
aagtttggaatactaaggaggaacttagcatccgttattgatagagaagaaaatgtggtgagaaaacctgngctcaaacggattcgaactcaggccggtag

SEQ ID NO: 56498 - DNA, 101 bp, rice(Oryza sativa)
  misc_feature (71): n=t or c
ggagaccgcgtccccttggattgaatgtgagggcgggaaaggcaaggcgcagattcagcagcaaggtggtngctggccaaaggtcgaaggaggagttgata

SEQ ID NO: 56499 - DNA, 101 bp, rice(Oryza sativa)
  misc_feature (71): n=a or g
taggacgccttttcttgggtttcttcctctttgtttgctaaggccctgttttcgggcggtgaaaagttttnttgtgtcacatcgcatatttgaagtattaa

SEQ ID NO: 56500 - DNA, 101 bp, rice(Oryza sativa)
  misc_feature (71): n=a or g
aagccagggaaagtggaagaacacgatccgttgcaacaggaatatgtggtttcaggcgatcttcgtaaganaatccccaacaagaacgaagagccctgaca

SEQ ID NO: 56501 - DNA, 101 bp, rice(Oryza sativa)
  misc_feature (71): n=a or g
ggggatgcaatgtacacgattttgtggttgagggaaatcagatcctatctatagttgagggagttcaaatnaaccttttctaatcctgttcggcccgtttc

SEQ ID NO: 56502 - DNA, 101 bp, rice(Oryza sativa)
  misc_feature (71): n=a or c
agccgcactactgtgtcagaacagctccatctttataaagtcaggagaactatgccaaagtccttgccaangtctccgtgcactggatttaataataaatt

SEQ ID NO: 56503 - DNA, 101 bp, rice(Oryza sativa)
  misc_feature (71): n=t or g
aggcactcctcagcggtcgagtcgacgccttcatcttcatactctatagatttatattgggaaagggtgantacttaacgtactcagcaagccagggaaaa

SEQ ID NO: 56504 - DNA, 101 bp, rice(Oryza sativa)
  misc_feature (71): n=a or g
ttcagttggaccgtacaagcagcaagccttgtaagccctatagcatgaaattgagttgtactgttcaccanaagccaatttacctgaatcacaatggatga

SEQ ID NO: 56505 - DNA, 101 bp, rice(Oryza sativa)
  misc_feature (71): n=a or c
ttctcgatgacgtgtatttgcttacttctaaaattttatttcggaaaaaaatgcttttcattgtctacaantaataccatttaaatttaaacataataatt

SEQ ID NO: 56506 - DNA, 101 bp, rice(Oryza sativa)
  misc_feature (71): n=t or c
gttagagatgccttttcgtctttaacgggctatgctgttgcacccgtcacatgtaagggatcacctttgangggtctctatgtgggtccgtcaaaggtgtg

SEQ ID NO: 56507 - DNA, 101 bp, rice(Oryza sativa)
  misc_feature (71): n=t or c
ttggtatcgattttataggaggggataaaatttagaaccgtgattaacagacctagttttaaccaaaatcncaaaaattaatttttaggaacctgtttagc

SEQ ID NO: 56508 - DNA, 101 bp, rice(Oryza sativa)
  misc_feature (71): n=a or g
gacgaacaatgtctcatcgacagcatactggagctcctaacgtacaggaggtatgcatataatcatcgtcncatcgatcgatctattatgtgtgctggatc

SEQ ID NO: 56509 - DNA, 101 bp, rice(Oryza sativa)
  misc_feature (71): n=a or g
acctatggatgttgttttgaccactgcacttattgaggtgtacaccaaatgcacaagagtcatgagatcgnagtatctctttgatcaacttattattaaag

SEQ ID NO: 56510 - DNA, 101 bp, rice(Oryza sativa)
  misc_feature (71): n=a or g
caaaccaaggaaactaggaggaacactaacactggttagatgaaaagacaaggcaaggtggaccaaaggcntcgaggataggtgtaggcaggacacgatgg

SEQ ID NO: 56511 - DNA, 101 bp, rice(Oryza sativa)
  misc_feature (71): n=t or c
tccacctttgtgcagtagggtcactaattaatgttattcatctcattggtcctaatccaatcaatgtttgnaatagcctaacaatacaaccatttcatgcg

SEQ ID NO: 56512 - DNA, 101 bp, rice(Oryza sativa)
  misc_feature (71): n=t or c
cttggtttttctcacttttttatttgtcaagtcaacgctgccattccatcgctaatcgctactactatagntcgctaccagtgcgctgactaagtcaacca

SEQ ID NO: 56513 - DNA, 101 bp, rice(Oryza sativa)
  misc_feature (71): n=t or c
gaaaacttgagaagatctgcagcttccaacccgaggtaatggtggaacggcaacctctgcaacgacgaggnggcgtccatggccatctgctgctgctgctg

SEQ ID NO: 56514 - DNA, 101 bp, rice(Oryza sativa)
  misc_feature (71): n=a or g
atgtaacaacagcagttgctagaaagtaagttagtgaggcaattgaactcacgttcataacccgcaatccnaagactctgggttaacctgttgtggcaaat

SEQ ID NO: 56515 - DNA, 101 bp, rice(Oryza sativa)
  misc_feature (71): n=a or g
ctacgactacatcccttacgctgacgaacaccggagcggttcgaggaactgctacctctacatccactccngtcgacggcattgcagagggaacaagaaga

SEQ ID NO: 56516 - DNA, 101 bp, rice(Oryza sativa)
  misc_feature (71): n=a or c
ctcgctataaaagcgaccaaccccttcgccttcgcctcaagtcacacgacgccatcaatcaccatctacanctctagagagctaattaagctaaggaaaga

SEQ ID NO: 56517 - DNA, 101 bp, rice(Oryza sativa)
  misc_feature (71): n=a or g
agagaaaaaatttagtacagattccatcagcaaaaatcccgggtattatagtccacaagtcttgtaactantgttattggaacctgctgggggaaaggcta

SEQ ID NO: 56518 - DNA, 101 bp, rice(Oryza sativa)
  misc_feature (71): n=t or c
ccacaacattttctgaagggaagttctctactagaattagcatgcttcgtttgatctattgagttacatgnaccaaccagtttaacccaaagcttaagacg

SEQ ID NO: 56519 - DNA, 101 bp, rice(Oryza sativa)
  misc_feature (71): n=t or c
tttactagttcagatgttgttgcttgactagattagattatgatgatcctgtcaaacgtgaatctgcattncgctgtttaagtggtctgcatttcgctgct

SEQ ID NO: 56520 - DNA, 101 bp, rice(Oryza sativa)
  misc_feature (71): n=a or g
tgctgggtaatccttgctttgcttgttgcttctccttttggaccaccgggttttgatcccggagcagcctntcgagacgatgaactggattggggctggct

SEQ ID NO: 56521 - DNA, 101 bp, rice(Oryza sativa)
  misc_feature (71): n=a or g
acatcatcatgattactggcctagacatctcagcatcggccaaccctatgaacttgaactccaagaatcantttgagttcaaaaccaaaaccataggtggc

SEQ ID NO: 56522 - DNA, 101 bp, rice(Oryza sativa)
  misc_feature (71): n=t or c
atgggcatgtgtgcagacaggcggtaaattagtcccacgtgtctttctctctcttaatcttctgtttttcnaactcaactagcacaaatataatgtaaatt

SEQ ID NO: 56523 - DNA, 101 bp, rice(Oryza sativa)
  misc_feature (71): n=a or g
atttgaaactaaaaagtcaaaagcgtcccgattagagaaaaatcgatgtgatatggtacaggaccgaaatnatcttaatcgtcctgttacagaatctactt

SEQ ID NO: 56524 - DNA, 101 bp, rice(Oryza sativa)
  misc_feature (71): n=t or c
cgattacatattatgttgatagtaaattttttagaccaccggcaactattagttattgctccatgcactgncatcaccgttctttctccataagccactat

SEQ ID NO: 56525 - DNA, 101 bp, rice(Oryza sativa)
  misc_feature (71): n=t or c
taccatgctccaaatccttttggaatatcgacattccgcaacaaggtgcaaggccgtttcatcctctctcntacagagggggcactgcccgttgttctgcc

SEQ ID NO: 56526 - DNA, 101 bp, rice(Oryza sativa)
  misc_feature (71): n=a or g
ctgcaatgtgcgattagagatgcaagcggatcgatccatcaacctatttatacgttagtgggtaacccgtnattactaatttactctattatgatctattt

SEQ ID NO: 56527 - DNA, 101 bp, rice(Oryza sativa)
  misc_feature (71): n=a or g
gcaggttaacctccttacaagtggagtacaccatctatcctacaaaaaccaacgcctagctttcaatctgnacataagctatatttaaattcaaagcagaa

SEQ ID NO: 56528 - DNA, 101 bp, rice(Oryza sativa)
  misc_feature (71): n=a or g
atcatatgcataaataaccgtagtataatttatcaataggcttgcgccaagccatcgattggccgatcccntctcctcttcaaccctcaaacaagagacgc

SEQ ID NO: 56529 - DNA, 101 bp, rice(Oryza sativa)
  misc_feature (71): n=t or c
tgccaccaaaccactcagttctcacactgtgggtcatgtactagaagagtacacgtgtgacactggaaagngggcccagactattaggctaattaactttg

SEQ ID NO: 56530 - DNA, 101 bp, rice(Oryza sativa)
  misc_feature (71): n=t or c
atctctctctctttcttactctatcgggcagcaggcccatcgatatctagaaagacgaaatgagatttttntttacggtgtttgatctaatggtccacaat

SEQ ID NO: 56531 - DNA, 101 bp, rice(Oryza sativa)
  misc_feature (71): n=t or c
taacttggccagaagaacgaaatatctgtagcttcttatggatttattgtaatactgagaaaaatatccanccaatagtggattcaccaaatgcagaacct

SEQ ID NO: 56532 - DNA, 101 bp, rice(Oryza sativa)
  misc_feature (71): n=a or g
ctggcgctgtgccaccgatgtcccctccacctccttgttcggccttcgatgcccattttcgccactggtcntcgccgccattgaacaccggcgttggtgct

SEQ ID NO: 56533 - DNA, 101 bp, rice(Oryza sativa)
  misc_feature (71): n=a or g
ttttccagattccaatcatcaatgaaattttgatagattcaaggacagcaacagcagccaaccaggcttcnagcgtagcaagaagtagcacaagcaaaaaa

SEQ ID NO: 56534 - DNA, 101 bp, rice(Oryza sativa)
  misc_feature (71): n=a or c
aaaaatgtggaagggggtgcagttgaatatatatactatggatttaaagatgaaacgaattaagagttgtncatctctttacagaagagtaaattgttcgt

SEQ ID NO: 56535 - DNA, 101 bp, rice(Oryza sativa)
  misc_feature (71): n=t or c
ttgaaaaacatggtaatggagacataggcaaaatctgaatgttaataatcagaaaagatcagaaaagtggngtaccttttccgcggagaacagcagcatgc

SEQ ID NO: 56536 - DNA, 101 bp, rice(Oryza sativa)
  misc_feature (71): n=a or g
ctattcctctgtttttccattcctacgattcaaaaggaccctacactatcgcaggaatgagaaaacgtagnaatagaaaaaacgtaggattttgataggaa

SEQ ID NO: 56537 - DNA, 101 bp, rice(Oryza sativa)
  misc_feature (71): n=a or g
ttacatgttggactctttaacagaaacaatggtgcagtttcatggtctttaaccaagaaattaggtgaggncaggaatgtagttaaagaggggaaaaacat

SEQ ID NO: 56538 - DNA, 101 bp, rice(Oryza sativa)
  misc_feature (71): n=a or g
tgaccggagcttccttctcatgtagacgaacatggctacagagatagccacagagatcaccatgagcgccncgttgccaatgccggtcgccatgagcgccg

SEQ ID NO: 56539 - DNA, 101 bp, rice(Oryza sativa)
  misc_feature (71): n=t or g
gggaatatatatttctaggtaggcaaagagtgaacgtacttatactttagtagtagtaatcagcagtgatngaccaagttattagttatatatatgcatgc

SEQ ID NO: 56540 - DNA, 101 bp, rice(Oryza sativa)
  misc_feature (71): n=t or c
ctgcaatttacagcataactacacagtcggcagctatctacttgctgcaacaatcaaattggctagagagngcgaaatagcatggtaaatagcaactgaat

SEQ ID NO: 56541 - DNA, 101 bp, rice(Oryza sativa)
  misc_feature (71): n=a or c
aagatgatggatgaagctctaatttatcaaatccagcccacaatacctgtttatataatgaagcatcaagnctacggttatgttcaaatttgcataatata

SEQ ID NO: 56542 - DNA, 101 bp, rice(Oryza sativa)
  misc_feature (71): n=t or c
ctttcgagaggcaatgccctccaaatccacaacactagagcgagcagaaaggacgatgcggcgagaaccgnggatgccgccatcgccatctacatcgaggc

SEQ ID NO: 56543 - DNA, 101 bp, rice(Oryza sativa)
  misc_feature (71): n=t or c
agtctgaactccgaagtctgatgaaactgaagaaaaacagaggagatcgagttctgaagattggacggccnggattaaacgcgaaggggtatggagtagat

SEQ ID NO: 56544 - DNA, 101 bp, rice(Oryza sativa)
  misc_feature (71): n=a or g
agggagctttattaaatcatatcaagattacattcttgagcaagaagctcagaaacattccctggagcctncaggcgccaaacgggtatcgttccatcgat

SEQ ID NO: 56545 - DNA, 101 bp, rice(Oryza sativa)
  misc_feature (71): n=a or g
atagtaccagtagtagaactagaatcatgttgataacatgttgtagaatagctacatcgatagatcctcanatccgctcccttctctcttgtagaaaataa

SEQ ID NO: 56546 - DNA, 101 bp, rice(Oryza sativa)
  misc_feature (71): n=t or c
aaccattttgaacatttgcagtttgagatcctccaagaataccagccatcacagatgcagcatgaatagcngatggaagaccaactggctgatgaagacct

SEQ ID NO: 56547 - DNA, 101 bp, rice(Oryza sativa)
  misc_feature (71): n=t or g
gatgggctggctacacggtcctggagggagggatgttatagtaatgtcaaaaatcgtgggtatgatttgtnggatttttagctacccacttgccgaataat

SEQ ID NO: 56548 - DNA, 101 bp, rice(Oryza sativa)
  misc_feature (71): n=t or c
ccatgaattaaacgtaaaacacaaaaccacaccgaaatcgactcctctctgtagtttactagtttgaccgngtgatagccagtctaaccagacctatttta

SEQ ID NO: 56549 - DNA, 101 bp, rice(Oryza sativa)
  misc_feature (71): n=t or c
agcaagatgttccaacttgaaaagttggaggcatgtcaactcatagcagatcaaagcacatgtctgcaatnttccgagcctataaagatcctgtagggcgt

SEQ ID NO: 56550 - DNA, 101 bp, rice(Oryza sativa)
  misc_feature (71): n=t or c
ccatcaggggttgagttaccgcacccaatcgtaagcacggtaatcacacggtaaaccatgaaaaactagangatgctattagaagttcatattattatgta

SEQ ID NO: 56551 - DNA, 101 bp, rice(Oryza sativa)
  misc_feature (71): n=t or c
tatcttaaattacctacgttccagacgatgccttaaaaattgaaatggaaagagatcctctgacctcgtgnagtttatacattaacatgttaatcccactt

SEQ ID NO: 56552 - DNA, 101 bp, rice(Oryza sativa)
  misc_feature (71): n=a or g
gttttctacgaaagtgtataactaggaagttgtagaaaattcatagacctatcttctgaccagagggcgcnattttatctttagttgtttaggatatatga

SEQ ID NO: 56553 - DNA, 101 bp, rice(Oryza sativa)
  misc_feature (71): n=a or c
atgcaagcatttttcatattcacatagcatccatatatcaattcaaattcaggaatttttcacatactagnatgtagaataaagtcacttatatatgataa

SEQ ID NO: 56554 - DNA, 101 bp, rice(Oryza sativa)
  misc_feature (71): n=a or g
gggctcaatctgaattcgcttcctcaaaccacagtaccaagatctgcacctcccttagctttgaaaactanagtcaacttacctctatgactagattgtac

SEQ ID NO: 56555 - DNA, 101 bp, rice(Oryza sativa)
  misc_feature (71): n=t or c
tttatagtaagataggatttgtgagctacattctgatttctcatgtttcacttgtgacagtacggcctcgncatcatcgtcagaagatgagtcagaggatg

SEQ ID NO: 56556 - DNA, 101 bp, rice(Oryza sativa)
  misc_feature (71): n=t or c
atagagatttcacttgaaataaatagtacttcctccgttttcgtataacacccgtttcaaagatatttganactgtttgatcattcgtcttattcaaaaaa

SEQ ID NO: 56557 - DNA, 101 bp, rice(Oryza sativa)
  misc_feature (71): n=t or g
tcgatggatggatttagattgattttgagatggaagacgatgatatggagtggagtggtatatatagggangctaccaaaagatcgtagcagttgggagtt

SEQ ID NO: 56558 - DNA, 101 bp, rice(Oryza sativa)
  misc_feature (71): n=a or c
tgttaatacttaaccaaaatcacaggttcaaaaaacttctgacaggacactacaaaacaaggtttcagtgnttacttgtgtaaacctgaatggcaccacct

SEQ ID NO: 56559 - DNA, 101 bp, rice(Oryza sativa)
  misc_feature (71): n=t or c
ggaagggtcccatggatgacattgttggtgtgggtcgacgacttgtgttttcctaggcagcttgaaaaccnaagcacattgtaatggagcaatgcatctgg

SEQ ID NO: 56560 - DNA, 101 bp, rice(Oryza sativa)
  misc_feature (71): n=t or c
aattttcgggccaattgttgtcttcactcttcaaccttcatccatgagttcctgataatttcatgtttttnatgttgagtttgtttgactggattttacct

SEQ ID NO: 56561 - DNA, 101 bp, rice(Oryza sativa)
  misc_feature (71): n=a or g
aaacaaccttgatgtattaaggtggtcacaatgtatagatcaagcgacgccaaagacgggtgcacgtgctngcaaccggcggaagctacgacgtgaagacc

SEQ ID NO: 56562 - DNA, 101 bp, rice(Oryza sativa)
  misc_feature (71): n=t or c
tacttattgatgaatctctgaatcactcctcatcactagcagtcagcaacaattcacactggaacattatnaattccattggatcgcaacgaaagaattag

SEQ ID NO: 56563 - DNA, 101 bp, rice(Oryza sativa)
  misc_feature (71): n=t or c
gctcatgttctaggcttctagcctccaatagaaataatagaggttggctttgtggattatataggctgtgntctttcccctcctttttccacctcgtctct

SEQ ID NO: 56564 - DNA, 101 bp, rice(Oryza sativa)
  misc_feature (71): n=t or c
ccgttcggcccaaccggtggggaacaaaagtcagggtgcacccggttggctgttgtcaaaccagcttggtncgggggcttcgccaaggagtcaaggaccac

SEQ ID NO: 56565 - DNA, 101 bp, rice(Oryza sativa)
  misc_feature (71): n=t or c
agagcctccacgtaaagtatcacctaagtggtactgttcatgagggatttccttcgaattacgcacaaaanagagggtttttttttctttttgcaaaattt

SEQ ID NO: 56566 - DNA, 101 bp, rice(Oryza sativa)
  misc_feature (71): n=a or g
ccccccccccaacaaggagctgctccttttcctcgtgatgtattgtgctctaattcttgcagcagtagcgncaggatctgctagtgctcgatctcatcatc

SEQ ID NO: 56567 - DNA, 101 bp, rice(Oryza sativa)
  misc_feature (71): n=t or g
catagcccacagaggatgagaatcactccgtcaaaatagctcgaaagaatgggaaaataaaacccaggatngtaacatttgctgtacaaaacacggaaata

SEQ ID NO: 56568 - DNA, 101 bp, rice(Oryza sativa)
  misc_feature (71): n=t or c
cagctagccgcctgcgataattagggggcttcctggaaaaaaattggcaccaaaatttaaaatctcccgcnaatttttttattaatgcttaatcaataacg

SEQ ID NO: 56569 - DNA, 101 bp, rice(Oryza sativa)
  misc_feature (71): n=a or c
tttttaagctcactgaaaactactgcaatgtaatgctggtaatgtgcagggtccatcattgatgtattaanttgtcctcttaattagctaattagcaatgt

SEQ ID NO: 56570 - DNA, 101 bp, rice(Oryza sativa)
  misc_feature (71): n=a or c
gtacgaccgtaacactagcgaatgcatggcgtcgatctctacaggactttgcctcacggcgttacgtgccnagctgatttcccgtttagtcgtacaccggt

SEQ ID NO: 56571 - DNA, 101 bp, rice(Oryza sativa)
  misc_feature (71): n=t or c
tcagtcagccaccattgcaatggcctcctcctcttcagcaattgtagtcggtggctctgcgtctgcaaccnggcgacgcagaggtgggagaagctcccgga

SEQ ID NO: 56572 - DNA, 101 bp, rice(Oryza sativa)
  misc_feature (71): n=a or g
cgtgcaaccgatgatttcagcgatgatagcatgttgggcttcggaagctttggaaaagtttttaggggacnattgagcaacggtatggtggttgccataaa

SEQ ID NO: 56573 - DNA, 101 bp, rice(Oryza sativa)
  misc_feature (71): n=a or g
aagcagcgtaaggaatgcatggccagcaattcaaccaggcgatcggatctccggtggtatccagtggcacnggaacgtagctcctcatggtcactctagtg

SEQ ID NO: 56574 - DNA, 101 bp, rice(Oryza sativa)
  misc_feature (71): n=a or c
tcattacagttgatggtggtgtcactcattgcaatgacactcttcttccgtacgaaaatgaaacgtgattntgtgaccagcgggggcatctacatgggcgc

SEQ ID NO: 56575 - DNA, 101 bp, rice(Oryza sativa)
  misc_feature (71): n=t or c
tgggtttacgggttggtccgcttgcatcctacttaaggcctttaataagtacaggttgaagcttcattggnatggttttccaaacttagttgcttgacaat

SEQ ID NO: 56576 - DNA, 101 bp, rice(Oryza sativa)
  misc_feature (71): n=a or g
aaaaccatcagactaccgatcctaaggtgcgttaaaggggaccgaagggcaaattcccatcatcactatcncaccgtggggttcccgtcaccactgccgca

SEQ ID NO: 56577 - DNA, 101 bp, rice(Oryza sativa)
  misc_feature (71): n=t or c
cttggacgttacaacagatagctcaaaaccggtgtttcatcacacaacacacagcagtctggtgtacgcgnaacgcaacgggggacaccttgtatgcgtcg

SEQ ID NO: 56578 - DNA, 101 bp, rice(Oryza sativa)
  misc_feature (71): n=a or g
cgtgctagtatttatgcgatttattcattcaatggtttgtgacgtggccgctgacacaaacaactgcgtgnttactttatcaatatcaagatatattaacc

SEQ ID NO: 56579 - DNA, 101 bp, rice(Oryza sativa)
  misc_feature (71): n=a or g
tgtgaaccggttgaggctgttgaaccaaagttaaacgcctatttatatttcgttcaaacacagcacaaacntacaattatacacatgcgcgcgtgcaccct

SEQ ID NO: 56580 - DNA, 101 bp, rice(Oryza sativa)
  misc_feature (71): n=t or g
cctccgcccggccgccgtccttgaggctgtaaacgccgacgaccctcttcttgtcgtcgcagctgtggtanctgtggaacccgcggtcctcgtccctgcag

SEQ ID NO: 56581 - DNA, 101 bp, rice(Oryza sativa)
  misc_feature (71): n=t or c
atattactacagatcattgctagcagtggacagcaaaacacaaactgtgtagaatgactctgccaagagcnttaaagaccacacgtagcttaatgtgttag

SEQ ID NO: 56582 - DNA, 101 bp, rice(Oryza sativa)
  misc_feature (71): n=a or g
aattatccgcaaaacagaaatcacgtgtgtttgtctcagttcgtcctctcctctcctatttttctgttctncaagccctgtgctggcgcgtcaaaatatcc

SEQ ID NO: 56583 - DNA, 101 bp, rice(Oryza sativa)
  misc_feature (71): n=t or c
gtttttctttgctatacttttgtgttattcaatcatgtgttttaacggagccttaggctctgtccgtttgnctgggttgggaacccatccctccagcacag

SEQ ID NO: 56584 - DNA, 101 bp, rice(Oryza sativa)
  misc_feature (71): n=t or c
atgagtgacacctaactatgatagaggacccacggattagacttaaggttttgggggtggggattttggcnggtggaagagagtggttcaactcccatagg

SEQ ID NO: 56585 - DNA, 101 bp, rice(Oryza sativa)
  misc_feature (71): n=a or g
agtgtagtagtcctaggactctatgagtgaggggttgaattgatgaatgctagccctgcttgctgttgaanctcgtagatcgtcagagattggtgccggcc

SEQ ID NO: 56586 - DNA, 101 bp, rice(Oryza sativa)
  misc_feature (71): n=a or g
ccaaaacctaggaatctaatgcttcgagctgacacaggagtccgccaacagtaatcgatgcaagggtaagnttctccaagacgatgcccccatgaaggata

SEQ ID NO: 56587 - DNA, 101 bp, rice(Oryza sativa)
  misc_feature (71): n=a or c
tgtttaaaacatcacatttcaaatgactggaaggagtataacatgattgagtaatgcatgacgtctccaanaaacgaagctagtactatttcttatctcct

SEQ ID NO: 56588 - DNA, 101 bp, rice(Oryza sativa)
  misc_feature (71): n=t or c
tcctcatgctcgttgcggcaatgttccaccaaatcatcctcttacaagttcagaggggcagctcgtcgtgnacaggcaaaggcaagcatctccaactctgc

SEQ ID NO: 56589 - DNA, 101 bp, rice(Oryza sativa)
  misc_feature (71): n=t or c
ccagtttggcacaacttcaagtctagctccactttttcgtaatctggagtacagccaaatggcttcagctncaccaaaataaatggtaagagtgaagcatg

SEQ ID NO: 56590 - DNA, 101 bp, rice(Oryza sativa)
  misc_feature (71): n=t or c
tccatcggcggctgctgctgctgcgcgcgcggagagagagaggccgaatcaagtcgtatcgcgacaggatnggaatgggggatcggcggttttaagtagtg

SEQ ID NO: 56591 - DNA, 101 bp, rice(Oryza sativa)
  misc_feature (71): n=a or g
aatgccttgactatatattgtattattgagtgtttcatccaacttttctattgctatgttatctgtcgagnagtgatcctctctagcgggagatcgtgaga

SEQ ID NO: 56592 - DNA, 101 bp, rice(Oryza sativa)
  misc_feature (71): n=t or c
tttgtattgaggcataaagtacttgtctaggtatatataggagttaggctgtgtttggtaatctgttttcncaactcttccctctcgtttttcatgctcac

SEQ ID NO: 56593 - DNA, 101 bp, rice(Oryza sativa)
  misc_feature (71): n=t or c
atcaaacactattcctagaacattactgaggctttacactagtgcgctagatataaaatttctactatttnctccgtttcacaatgtaagtcattctagca

SEQ ID NO: 56594 - DNA, 101 bp, rice(Oryza sativa)
  misc_feature (71): n=a or g
aagcaacaattgggaaatttaaccatttgcaacccaacagatgtgaggtgaattattttgcacttgagagntaccaagggcatgtgcaacagtaatcgatt

SEQ ID NO: 56595 - DNA, 101 bp, rice(Oryza sativa)
  misc_feature (71): n=a or g
aagaagaaaaatgctgattcggatgatgcagagtctacctgaaattctgaatcaataaaggaaggcgaacnaaatcacagtataatcaaaagacaaaaatt

SEQ ID NO: 56596 - DNA, 101 bp, rice(Oryza sativa)
  misc_feature (71): n=t or c
ttgataacctgtctcttagaacatacttgcaactcaggatacgatagagcaggcaactgctttgggtgganttaaagctactgcctcttccgatgttgctc

SEQ ID NO: 56597 - DNA, 101 bp, rice(Oryza sativa)
  misc_feature (71): n=a or c
aatgtattcatttcagttttgcatgtagatagactaatttaaccaatttaccactggtgcttaaccacttnacatatttttggacatacgcagcttatatt

SEQ ID NO: 56598 - DNA, 101 bp, rice(Oryza sativa)
  misc_feature (71): n=t or g
gtggttatgtatcttactcgatagtactctttgaggacatcaatggatctccttgagatttggctgatcanctcattgctctcatcaaaatggcgtccata

SEQ ID NO: 56599 - DNA, 101 bp, rice(Oryza sativa)
  misc_feature (71): n=a or g
tgtatattgaagaacttcaaggggcaattcacaaaccatgtccaccatcatatcatcttttagcatctatnctcctttaaaagaacatagcggtggtggca

SEQ ID NO: 56600 - DNA, 101 bp, rice(Oryza sativa)
  misc_feature (71): n=t or c
tctatgatcaaagcgatcatcgctccttctccgtatttattgccgcttcagcttggcctcctttcaccaanggaggaattacgagtaataaaaagaattat

SEQ ID NO: 56601 - DNA, 101 bp, rice(Oryza sativa)
  misc_feature (71): n=a or c
cgcttttctataaaagctgggtcattcggcctttggtctaggagaaaaaagaagagtgggttgttatacanatacaactccaccctagctagaaatgattt

SEQ ID NO: 56602 - DNA, 101 bp, rice(Oryza sativa)
  misc_feature (71): n=a or g
gttagaagtttaaataaaaagtttggaactaaactcggccttggatagtcagctccgatcaaaggagctanctagcaggcgagacagtgttccaacttcga

SEQ ID NO: 56603 - DNA, 101 bp, rice(Oryza sativa)
  misc_feature (71): n=t or c
atgacattggagtctcagacggtcagaccctgaaagtttgatgcaagtcaaatggattatcaacagacaanagggtagccgacaagatagccaaggatggt

SEQ ID NO: 56604 - DNA, 101 bp, rice(Oryza sativa)
  misc_feature (71): n=t or g
ttacccggccttatgctctctatttatggccattggttatgtaaaatgtccactagtttaccaaatcaaancattaattcatatcctaaccttaagtattt

SEQ ID NO: 56605 - DNA, 101 bp, rice(Oryza sativa)
  misc_feature (71): n=t or c
tttttcataaaaatcatcccgattagtggcttgggaaacgtccccgtggcgtcaattttgatgccttatanaagatacttggttcaatcttttgagagatt

SEQ ID NO: 56606 - DNA, 101 bp, rice(Oryza sativa)
  misc_feature (71): n=t or c
tgtacatctaaatcctattattactttactgtatcacccgagattagatgcagatgtggcagctctggtanggctatccacggcatgtacacttttgtatt

SEQ ID NO: 56607 - DNA, 101 bp, rice(Oryza sativa)
  misc_feature (71): n=a or g
gcccaggtattacacgcttgacagcacgaaatatgttagcttgcccttggttagtgcctcgaggaaatccngttgtgtaggtatcaatgtctcgtagcgag

SEQ ID NO: 56608 - DNA, 101 bp, rice(Oryza sativa)
  misc_feature (71): n=a or g
cgcgttgaaggaaggggttgagatgcagtggccacggaaggtgctcggcggcggaggcagtgatgggtcancggtaaaggacctacggttcttaggataaa

SEQ ID NO: 56609 - DNA, 101 bp, rice(Oryza sativa)
  misc_feature (71): n=a or c
gcgcggttgttcacttccgctcctccgtcaaatgggccgaatgagttggtgtgctgggaagatattgtgcntgagataagagcaagtttaatagtatagcc

SEQ ID NO: 56610 - DNA, 101 bp, rice(Oryza sativa)
  misc_feature (71): n=t or c
aattctgtcttctgtgagatccatccacaaaaaaaaactaacctagaaacttttagatcttctctgtattnttcgacaaacaaattgatatgaatctgtgc

SEQ ID NO: 56611 - DNA, 101 bp, rice(Oryza sativa)
  misc_feature (71): n=a or g
ttagttaagagtgacagttttgtatgtatgcatgcagtcgagaatccaaaaggtccatgtgagcaacaggntagggattgacggtgtactgtacactgcac

SEQ ID NO: 56612 - DNA, 101 bp, rice(Oryza sativa)
  misc_feature (71): n=t or c
ctattactagactagcgtcacttgttgcctccatgtgcttgctgcctcaatgcgcttatcaacagaatccnaccgcatctcacaactctcccgttacatcc

SEQ ID NO: 56613 - DNA, 101 bp, rice(Oryza sativa)
  misc_feature (71): n=t or c
agacgcactaataactgatttaagatgcctgccatttgttaaggtttccatcaagatgtgtggtgttgcgntgttgccaaaagtgttttcttgtcgatgcg

SEQ ID NO: 56614 - DNA, 101 bp, rice(Oryza sativa)
  misc_feature (71): n=a or g
ttttattataaatctttatgtgcgagtgactttttaaaaatattttttacggtattctaaacttgttttcntcaataatttatttggtttatttgggattg

SEQ ID NO: 56615 - DNA, 101 bp, rice(Oryza sativa)
  misc_feature (71): n=t or c
tccagaaccaggatgaaatgatcaaggctggtaggctctcagagccatacaagggtattggggactgcttnggacgcactatcaaggatgagggttttgct

SEQ ID NO: 56616 - DNA, 101 bp, rice(Oryza sativa)
  misc_feature (71): n=t or c
cttctactgcattatcttctgcaatccctaccaattccatggacgcaaattaatagttctacagtgaagtntacttttatttccacacccacagaaatagt

SEQ ID NO: 56617 - DNA, 101 bp, rice(Oryza sativa)
  misc_feature (71): n=a or c
cttcccggagaaattccggtgggtttagaggcttcgaaatccggtaaattcccgatcccaaaaccctaatnttgagtttaatctggatttaattcgggttt

SEQ ID NO: 56618 - DNA, 101 bp, rice(Oryza sativa)
  misc_feature (71): n=t or c
cgctcgtctgttctacatcgaatatgacgacaacgtcgaaggggacatggagccggcccccgacgagccgngtgtgtcgctcaacgttctcgccgggttgg

SEQ ID NO: 56619 - DNA, 101 bp, rice(Oryza sativa)
  misc_feature (71): n=a or c
gctgtagctgtgtggtcgcggtgatgaaatgaatttgccaaccgatctgccgatacgatacgggtggtatntggggaaggaaagatttttggaattttcgt

SEQ ID NO: 56620 - DNA, 101 bp, rice(Oryza sativa)
  misc_feature (71): n=a or g
tggatttgttccaacagaggtgtacaaatttcttattttgtgaatgattgctattttgtggccaagtttanggcatcatatgcaggtagagtaccaactat

SEQ ID NO: 56621 - DNA, 101 bp, rice(Oryza sativa)
  misc_feature (71): n=a or g
ggacgtgtcgagggtgcagaaggagctgacggagtgcaaccgggacagggaggtctccggggtgtccatcncgctccacgacggctccaccatctcccacc

SEQ ID NO: 56622 - DNA, 101 bp, rice(Oryza sativa)
  misc_feature (71): n=t or c
tgcagatttgattgcagtggcaatggcatcatctgagttccgttgccttatttattcaatttagtgatccngagacatttgttaggtcacagtataacttt

SEQ ID NO: 56623 - DNA, 101 bp, rice(Oryza sativa)
  misc_feature (71): n=t or c
tctaactcttctgtcattgctgctcgctcgagttgatctgatttaaggtcggctagtcttgttttccatancgtggaactaggagctgccaccgacacagc

SEQ ID NO: 56624 - DNA, 101 bp, rice(Oryza sativa)
  misc_feature (71): n=a or g
gaaggtaagggagatattaaacccggttttacgattgaaagatcggattcgaccatggggaagaaatgagngaggaagatagacttactcctaagcttaac

SEQ ID NO: 56625 - DNA, 101 bp, rice(Oryza sativa)
  misc_feature (71): n=t or c
ccccgaccctcttaggagtgaaagttcattgtttttttacttatcttacgtaattatcttacttatgtttntttataaatgataatcttgtgttttatcat

SEQ ID NO: 56626 - DNA, 101 bp, rice(Oryza sativa)
  misc_feature (71): n=a or g
ctaagagaatagatgtagggagcttgtacaattattgccgatatttggctatatatcgatatgactgtcanttaactaattgtgtgaaatcaaagtgtgct

SEQ ID NO: 56627 - DNA, 101 bp, rice(Oryza sativa)
  misc_feature (71): n=a or g
ctgccacatcaccaaccaaggtggcactgagagcgtgaaatgtctatcttgcccctgcctcttctcaactnttatgttttaacataaaaattacacaaatt

SEQ ID NO: 56628 - DNA, 101 bp, rice(Oryza sativa)
  misc_feature (71): n=t or c
tgaagtgcagggcctactgcctatctcaccaagcagttcacaacagacattagctattatgccagcagacncaagcagctctctccaactagcaccagcaa

SEQ ID NO: 56629 - DNA, 101 bp, rice(Oryza sativa)
  misc_feature (71): n=a or g
cccctgcaattaactggccttgatgcttagagcatccctggcattactctgaattagatgcaaccattacncccttgtttatcagttatttccctggtaga

SEQ ID NO: 56630 - DNA, 101 bp, rice(Oryza sativa)
  misc_feature (71): n=a or g
agggtgctgttgtgcatcccatctcctctcatggggctgtcgggtgaaaacctagtctcggttctttttgngacctcgacggacgtcagcggcgatggttt

SEQ ID NO: 56631 - DNA, 101 bp, rice(Oryza sativa)
  misc_feature (71): n=a or g
catgcatggcttgtcagggtcatagggcatcaccaactcccctggtacttcatcagacacaggaattgctnccccagtagtgtcttgagcagcatcaccca

SEQ ID NO: 56632 - DNA, 101 bp, rice(Oryza sativa)
  misc_feature (71): n=t or c
tcctttcccccgcctgcgaaaactatttgtggccgcctgaaaagacgattcttctagggcctgtttggtanagtccaactccttaatttagctccaggagt

SEQ ID NO: 56633 - DNA, 101 bp, rice(Oryza sativa)
  misc_feature (71): n=t or c
cgatcccccttacctttgcccaacctgacgtctccatcgatttatctgctgctgctgctgctataaaaacngaagcaagaacaacaaagatgcatgctagg

SEQ ID NO: 56634 - DNA, 101 bp, rice(Oryza sativa)
  misc_feature (71): n=a or g
atctctacttatagaaataagagtctacacttggccgtctttatgtcacaagattaatggactcaagatcntccactacactggccaaggtcacctgtaac

SEQ ID NO: 56635 - DNA, 101 bp, rice(Oryza sativa)
  misc_feature (71): n=a or g
tgctcccgttgttgggggagggggtacggtggatctgcccgctcccattgtcctgaggttacccatcaccnagcacccgagatagccgccgttgtcgctgc

SEQ ID NO: 56636 - DNA, 101 bp, rice(Oryza sativa)
  misc_feature (71): n=a or g
ttatggtaaccgaatctctcataatatttactacttaaaaagagccttatggtgattgtgagaccgtcacntggtatgccatacttccctccctccctctc

SEQ ID NO: 56637 - DNA, 101 bp, rice(Oryza sativa)
  misc_feature (71): n=a or c
ctgccattgatttgcgcgcttggattggatagagagatcgatggtggcgtggattgacttttagctgctgnttggttccaggaaggcagcgaatcgggtag

SEQ ID NO: 56638 - DNA, 101 bp, rice(Oryza sativa)
  misc_feature (71): n=a or g
catttcgggctgacgagatgccaagaccctgtgcatgcaagctgctaggtcctccatgtacttgttctttntactactagaacgacaaatttctgacatgt

SEQ ID NO: 56639 - DNA, 101 bp, rice(Oryza sativa)
  misc_feature (71): n=a or g
tggttaatttgatttctgttcgatcggagtcgcagctgtttgttagatcgctaattgttttgtcgacgacnacgctttctgcctgacttcctgccaatggg

SEQ ID NO: 56640 - DNA, 101 bp, rice(Oryza sativa)
  misc_feature (71): n=a or c
tttaacttatttttgaaatatttattttactgttcccgagtggggcctctcggcaattaatttaccctccnctaaagcaatttatccttggagggggccgt

SEQ ID NO: 56641 - DNA, 101 bp, rice(Oryza sativa)
  misc_feature (71): n=a or g
atatttctgtccttattttgtttagagagagcaagagatattttctgttcctctcctgtccccacacaccnggggtctccctctctcctctcctcttcctt

SEQ ID NO: 56642 - DNA, 101 bp, rice(Oryza sativa)
  misc_feature (71): n=t or c
gaagtatggacctgactgctgactgaggagagtgatgaccggtaaattcttagactgtcaagttgttgtanttcctccgttgatttttctattagttaaat

SEQ ID NO: 56643 - DNA, 101 bp, rice(Oryza sativa)
  misc_feature (71): n=a or g
aaagctgactgaaagggagattaacgccgtacagcctgatacacccaaatatcttcagtgctcagagacancaatcaagtttgaccgctcgaatcatcctg

SEQ ID NO: 56644 - DNA, 101 bp, rice(Oryza sativa)
  misc_feature (71): n=t or c
tagtaagccaaacgaatgcagcgttgtgtgccgcaatgtacgtacagccatgtgtatttgcttgacctggntagggccatggtttgaaatttcagaaattt

SEQ ID NO: 56645 - DNA, 101 bp, rice(Oryza sativa)
  misc_feature (71): n=t or c
atgtggtgttgtatgtatagaggtgtgtatgtatgcacgtgcatttgcatgtcgtataaaaaaaaaactantaccacatgcatggtacctaccacacacac

SEQ ID NO: 56646 - DNA, 101 bp, rice(Oryza sativa)
  misc_feature (71): n=a or g
tgttttcacttcccaccgagtttggcgtatactttcactttgcactagaggatgacaaactaactttcacntaacaccaggctgtaggatttgggttgaac

SEQ ID NO: 56647 - DNA, 101 bp, rice(Oryza sativa)
  misc_feature (71): n=t or g
gtgatcggtcggttgcttgcttctagtttctctcaacttgtgtgagagctcgttcgaatgtttgatgtgtntatattttggttaaactctgaaattgcatt

SEQ ID NO: 56648 - DNA, 101 bp, rice(Oryza sativa)
  misc_feature (71): n=t or c
aagagtggcaaatagttaaaaacccccccttttagctgccgctgcaagaacctggttctggttcttgatgngaacgattgaaagacaaagtatgattcgtg

SEQ ID NO: 56649 - DNA, 101 bp, rice(Oryza sativa)
  misc_feature (71): n=t or c
gtacttgcatggcatactggagtcgatcgcgcggattgaggtgatatcttttttctgcgctgcattagcangagttaaaagaaaaactgaattattggaca

SEQ ID NO: 56650 - DNA, 101 bp, rice(Oryza sativa)
  misc_feature (71): n=t or c
atggccggcataggtgcctgtatgagaaaaaggggttttcaaatgtggtcgctctgctcgtatggaaaganacattttcgtagacatctggtgcgggcgtg

SEQ ID NO: 56651 - DNA, 101 bp, rice(Oryza sativa)
  misc_feature (71): n=t or c
tccagaaagccatctcgacttccaatgcatacgatgaccagttcaagcagcttatattagctggaaaggangcagagagcgcttattgggaacttgtcatc

SEQ ID NO: 56652 - DNA, 101 bp, rice(Oryza sativa)
  misc_feature (71): n=a or g
atgtgtggcttcgctagtgttagcaaagcccatcatacattctctccctcgtccccgcctatcctccttancccggtggtgtattcctgttgtcttcctca

SEQ ID NO: 56653 - DNA, 101 bp, rice(Oryza sativa)
  misc_feature (71): n=t or g
taggctgcgccggcctgggctgggcaaggtagggaagaaataaagagacgaggaaaaggaagtgttaaggnaccaaacttttaagaaaaggcacattttgc

SEQ ID NO: 56654 - DNA, 101 bp, rice(Oryza sativa)
  misc_feature (71): n=a or g
tgtgagctaatttacttcattcctcataaatcttctgtgtcaagctttggtggtttcccatggctgtcttnaaagtgacaacttatatgtttcctttgagc

SEQ ID NO: 56655 - DNA, 101 bp, rice(Oryza sativa)
  misc_feature (71): n=a or c
acacagttaccgcctgggtagggtcgataccactacaccaagcttacgatgccaataatataaaccatttntgttatcttaaatataggaaaaactataaa

SEQ ID NO: 56656 - DNA, 101 bp, rice(Oryza sativa)
  misc_feature (71): n=t or c
ataggctagaatttcagcttaactacatccagaacctccatgaacagaccagacatcacagcacagccaanagtcaaattgttaaatgtcaatcaggaaca

SEQ ID NO: 56657 - DNA, 101 bp, rice(Oryza sativa)
  misc_feature (71): n=a or g
ttacattagctgttcaatgattgttatcattccaaatgagcagtgaatgaagttggtgctaatgataagtngtaatcaaggcaaaagtagatacatcaggt

SEQ ID NO: 56658 - DNA, 101 bp, rice(Oryza sativa)
  misc_feature (71): n=a or g
gtgtgcacataacttgaccagagacagacgtacggcattcagacttaatgatttattatgtccatgtacantactttctccgtttcacaatgtaagtcatt

SEQ ID NO: 56659 - DNA, 101 bp, rice(Oryza sativa)
  misc_feature (71): n=t or c
ggttggattcagagcggcgcactgcctgaggcaaggtcagggcaggatttggatggcggtgtgttggcgangactttgggatgcagaggatgggacctgtg

SEQ ID NO: 56660 - DNA, 101 bp, rice(Oryza sativa)
  misc_feature (71): n=t or c
tgtaggagtgctaggagcccaaatcggtgacatttctttcagcgtttcgctgaacatagtgtagatttgcntgcaatgggtttgcctcaggttaatccagc

SEQ ID NO: 56661 - DNA, 101 bp, rice(Oryza sativa)
  misc_feature (71): n=a or g
ataaaatgagtttcttcacacaagatgaactgtacataaagggcaagtgcaatgcaatgtaggaaaaaacntatgaatgataaatcctgcattaaatatta

SEQ ID NO: 56662 - DNA, 101 bp, rice(Oryza sativa)
  misc_feature (71): n=t or g
gccaacttttaatttggactgggctaaccctccgtcttaaaatatctatacacctaatttaaaaccacatnattcaatgacatgtgggtcagggtggcata

SEQ ID NO: 56663 - DNA, 101 bp, rice(Oryza sativa)
  misc_feature (71): n=a or c
tgtacagtactgaaatatctcatacattgataaatggtacgttagttaaccaaacaaatgattccataagnatgtttttgtgttcaacaaaacattttgcc

SEQ ID NO: 56664 - DNA, 101 bp, rice(Oryza sativa)
  misc_feature (71): n=t or c
gcgagcagacacgacactctgcaaatccatctccgtcagagatttcagctaattaatctgcagataagcantcgatgatcgagtcatccttggttgtaaac

SEQ ID NO: 56665 - DNA, 101 bp, rice(Oryza sativa)
  misc_feature (71): n=t or g
aaatcatgaggcacacgcgtcggttcatttactactcctattcgttaatactagggtttagggaagcgatngatctatctctaagctttgtttgttgcggt

SEQ ID NO: 56666 - DNA, 101 bp, rice(Oryza sativa)
  misc_feature (71): n=a or g
ttctccttttccggtatttatctaaacgtgcatcataactttttcatagaggaagcacacacaactcaacnaaagctataaattgctcctaagcataattt

SEQ ID NO: 56667 - DNA, 101 bp, rice(Oryza sativa)
  misc_feature (71): n=a or g
atacgttcactgttttccagaacaggtttccatgctcattggttcttcgaaggttcttggcttcgcatcangcacgcgcgcagtttcctagggcagtcaac

SEQ ID NO: 56668 - DNA, 101 bp, rice(Oryza sativa)
  misc_feature (71): n=t or g
cctgcagccagctactgatcacatatacgaaatatatgtatttatatattcaccaaggttttaaatctctnactattagtcactatctctagtactccctc

SEQ ID NO: 56669 - DNA, 101 bp, rice(Oryza sativa)
  misc_feature (71): n=a or c
gtcctatccaaccggttgtcggatctctgaattggtttgagttcaaacccggaccgaccggttcgatcaangggttgttttttggcttggtccattccctc

SEQ ID NO: 56670 - DNA, 101 bp, rice(Oryza sativa)
  misc_feature (71): n=a or c
acattccacagtaatcatggtcttgttactgttctttgctaggatctagattctatgtaatggcgccactnatgactttccaccatgttcgctgtttcaag

SEQ ID NO: 56671 - DNA, 101 bp, rice(Oryza sativa)
  misc_feature (71): n=a or g
cccacctcccccgtcgactgatcctaatcattctcctatttttgcatgcgggcgagtaagagccctttgcntgcggatattttaagtggtcaatttggaaa

SEQ ID NO: 56672 - DNA, 101 bp, rice(Oryza sativa)
  misc_feature (71): n=t or c
gaaattttgaatgcacactttttaggcatgacactgcaaagcagatcattgtcattgatatatatgaatgncatgttttcttttcctaatggtccccatgt

SEQ ID NO: 56673 - DNA, 101 bp, rice(Oryza sativa)
  misc_feature (71): n=a or g
ttcctagagctcactggttggcctctgcgtggtcaacgggactcggggacggcgaacttatcctggagccnacgacaatggatccaactccactcaatgcg

SEQ ID NO: 56674 - DNA, 101 bp, rice(Oryza sativa)
  misc_feature (71): n=t or c
agagccacctgcgatcgaccgtctgcaaaaaggttaagcatcttaaaaacactccctacccaccaaaaatngctaagttggagtgctgccatcccacctct

SEQ ID NO: 56675 - DNA, 101 bp, rice(Oryza sativa)
  misc_feature (71): n=a or c
taagaaaacgttacctacaagggattcccaaccggcatttatgccatgttatgtactctgtagtagtggtnattgataaaatcggagaaaatattattagt

SEQ ID NO: 56676 - DNA, 101 bp, rice(Oryza sativa)
  misc_feature (71): n=a or g
ctacatcctccgtttcgcctctccgatcgccgcgacggcggcattcgtgctgttttggctccacagcaagnaaggtcaggcgacggccgacgtcgtgatca

SEQ ID NO: 56677 - DNA, 101 bp, rice(Oryza sativa)
  misc_feature (71): n=t or g
atatttgccacctttcacttgttctttcagactccaacgctgttgtgctgactaaagaacttggacatctncaggcccttatggttgtcaggtgatctgca

SEQ ID NO: 56678 - DNA, 101 bp, rice(Oryza sativa)
  misc_feature (71): n=a or c
agttagtacagacaaaatgctgaggggacttagtttcagagatgggtatacctatgttgattcttagtagnatttagcaattttacagcctactcagctga

SEQ ID NO: 56679 - DNA, 101 bp, rice(Oryza sativa)
  misc_feature (71): n=t or c
ggaggccgtgccccacccgcagcgagaggccgctccatgtctagaggctgccggcccagctccctcatctngatcgccctcctccgacccgcgcactgccc

SEQ ID NO: 56680 - DNA, 101 bp, rice(Oryza sativa)
  misc_feature (71): n=a or g
gcttcatgcgatacatccccaaagattagttactcagccaaataaaacttgactgaaaagaattccggtancttagcctccgcgtcgcccacgcgcgggtg

SEQ ID NO: 56681 - DNA, 101 bp, rice(Oryza sativa)
  misc_feature (71): n=a or g
tacccaagtttcactttggaccacccttaaatctatcttttcatttggaccgaataaatttatcattgttncggtttggactaccatgaacaatttttctc

SEQ ID NO: 56682 - DNA, 101 bp, rice(Oryza sativa)
  misc_feature (71): n=a or g
gcatcgggcaagtagcacagtaccactagtagtaacgcacactggaagtcacacaggcttggcagttcacngtcctccacgcgcggttctccaacctcgct

SEQ ID NO: 56683 - DNA, 101 bp, rice(Oryza sativa)
  misc_feature (71): n=a or g
gccgcatttaatgcggcgtggctggtcgtgcaacgtccaatcaattgacatgcgtcaattgcccttgactnggttgagaccgggcagatgggacgggcggc

SEQ ID NO: 56684 - DNA, 101 bp, rice(Oryza sativa)
  misc_feature (71): n=a or c
aaaaagcagcaatgacaactgtttgttccccaaaactagcgagtgttttaccatagaagaagaaatcaatngcaaatgctctgacctcccaaaagaatatg

SEQ ID NO: 56685 - DNA, 101 bp, rice(Oryza sativa)
  misc_feature (71): n=a or c
gatagtaggactcataaatcaatgaatcaattagtagttaagattgctgctacgtggtcagtggagagcantgctttagtgggaaatatttcttatttctc

SEQ ID NO: 56686 - DNA, 101 bp, rice(Oryza sativa)
  misc_feature (71): n=a or g
atgtcttgatagatgctggcactggctttccgcatggcaccacaacatcatccctccatttcgcaaactcngactcgagcggcacggttttgcctaagccc

SEQ ID NO: 56687 - DNA, 101 bp, rice(Oryza sativa)
  misc_feature (71): n=a or g
aatgtcatattccacgagggaaaattggggtgaaatttaaattatttgcatcctgctcgtcaagcttcgtnatttgtacatccatatactccatctctagt

SEQ ID NO: 56688 - DNA, 101 bp, rice(Oryza sativa)
  misc_feature (71): n=a or g
ggtcgaggacctggagctggttcagtcctgctttccctactcgatctctgattttccttgttcctatctcngcattccgctatccgttcgcaagttgccga

SEQ ID NO: 56689 - DNA, 101 bp, rice(Oryza sativa)
  misc_feature (71): n=a or g
aatatttcacttatcatactacaggtcggactgttgatttactgaatttggtgtgacaagtgaagcatganggtggtaaattaacctccaacgagcactct

SEQ ID NO: 56690 - DNA, 101 bp, rice(Oryza sativa)
  misc_feature (71): n=a or g
cttaaaagccaactcatcttccttccgtccacttcttccacgacgctctcaacatgcacccacacatagcntatgtatgtaaccaccgaatacaatgtttt

SEQ ID NO: 56691 - DNA, 101 bp, rice(Oryza sativa)
  misc_feature (71): n=t or c
ctatggagtatggaccatatcgggtcatttcagtatgcacccaattttttgaacactagttaagtgcatgnacattgcaacagaaaaaggaatatagtctc

SEQ ID NO: 56692 - DNA, 101 bp, rice(Oryza sativa)
  misc_feature (71): n=t or c
aagttacacaagctagagggaagtaagttagagaatctcaatccgagccgtgataccaccagaaccctcantggtggagaaacattctttactcccggttg

SEQ ID NO: 56693 - DNA, 101 bp, rice(Oryza sativa)
  misc_feature (71): n=a or g
tccacaagcttatgcatgattggacggggaggatcgcactcaccaagaatttcgtccagcttgcgaaaccnctgtgggcagtcattgtggtcgttgtcgat

SEQ ID NO: 56694 - DNA, 101 bp, rice(Oryza sativa)
  misc_feature (71): n=t or g
tgatttttttggaaggaaaatttcaacattgttccggaaggaagtataattgttgatgctgatcggatcgntattacacgggaaaattggaaccatgccat

SEQ ID NO: 56695 - DNA, 101 bp, rice(Oryza sativa)
  misc_feature (71): n=t or c
actgtgggttagttgacaaaaataaggatctcatggccaattggttgacaatttaaaaatgcatctcttgngttgttgtctaatcaaggctagaacaacga

SEQ ID NO: 56696 - DNA, 101 bp, rice(Oryza sativa)
  misc_feature (71): n=t or c
aattctagatcaagttggtttaactgcaattacatggccgatctaactgatgcttcaataccggtctgacngtagcttcttcgtcggtctgacagagcaca

SEQ ID NO: 56697 - DNA, 101 bp, rice(Oryza sativa)
  misc_feature (71): n=t or c
actcaggcctttctgagttgaggaatttttgaattttttttatggttgtcatatcggatatacacgaatanacatttaaagcattaaacgtaatataataa

SEQ ID NO: 56698 - DNA, 101 bp, rice(Oryza sativa)
  misc_feature (71): n=a or g
ttcgattttggcaataatttgtcaggtttcttctatctctatattctcattttgctctttaggtattgtgngtctcaaacactttattttattcttcggtg

SEQ ID NO: 56699 - DNA, 101 bp, rice(Oryza sativa)
  misc_feature (71): n=a or g
ggtaattcgtatgaactacgccaactacatgattgaacttgtcagtccaacgattcccatgatgataccanttcagatgctctggttcttccaatattgct

SEQ ID NO: 56700 - DNA, 101 bp, rice(Oryza sativa)
  misc_feature (71): n=t or c
gtgaccaattagttttcattaagatgtccatgttgatcattcagtgtggtcttgtttgatttaagggagtngattgtctcttactttgccctggtggttta

SEQ ID NO: 56701 - DNA, 101 bp, rice(Oryza sativa)
  misc_feature (71): n=a or g
atcaattgaagtgacgaccaaaatttgcgtgttcacatatctcatgccccttcgtattttaacagataacnttatcttttaaacatattttagcaattcat

SEQ ID NO: 56702 - DNA, 101 bp, rice(Oryza sativa)
  misc_feature (71): n=a or c
ttgcatgctgcttgaacgtttccaacacgtggcgtgagtctcggttgagtgatttcgccggctgttagttntgtaatttgagtctatatatataaagagaa

SEQ ID NO: 56703 - DNA, 101 bp, rice(Oryza sativa)
  misc_feature (71): n=t or c
ctccaccacctccttctccgcctcccactacgacgacatgttcgactcctacttcaaccgctcggcggagnccgccgagccgtccccctcgtcctccgcgc

SEQ ID NO: 56704 - DNA, 101 bp, rice(Oryza sativa)
  misc_feature (71): n=a or c
taagcgtactaaaaccagtatgagtactactgatagaacaccaaaaatcttcagcaatagtcccactgtcnaaagtatctgtttgactggtgcggctaaaa

SEQ ID NO: 56705 - DNA, 101 bp, rice(Oryza sativa)
  misc_feature (71): n=t or g
aggattctttctgttgcaagtcacacagccaattcgtttttcccactgtttggtagctactgaatcatcgntaggtcgttggttcatccatcagatgatga

SEQ ID NO: 56706 - DNA, 101 bp, rice(Oryza sativa)
  misc_feature (71): n=t or c
aatagtagggagatccataacaataacaaggagagctccatcatgggtttctgctctgtagctgtgtgttnagatgaacaatttgctgtctgtaatgatcg

SEQ ID NO: 56707 - DNA, 101 bp, rice(Oryza sativa)
  misc_feature (71): n=a or g
tgtggaaaaagaatgcacctaggtgtacatgtcattgtgtgtttgtggttggttggccaataatgaattgnaacacatgcacatatatattgatagatcat

SEQ ID NO: 56708 - DNA, 101 bp, rice(Oryza sativa)
  misc_feature (71): n=t or c
tagtacaaaatatttatttcttgatcttttttcaccagggaaattcaaaaaccaggacagcactatttttntagtagtggccagatatatttgttttgaga

SEQ ID NO: 56709 - DNA, 101 bp, rice(Oryza sativa)
  misc_feature (71): n=t or g
atctgcacaatatctggtaccccataggtaccgggcattaatacatgtcaagtacaaaactgatacctcgntggtctcggtcattacctaacaatatcgcg

SEQ ID NO: 56710 - DNA, 101 bp, rice(Oryza sativa)
  misc_feature (71): n=a or g
ggttgtgcaggcagctgagcgtcgaatcggagaactccccacatgcttccagcttgagcgatttcaaaganggtggcaaggccaagcctggctcccaattg

SEQ ID NO: 56711 - DNA, 101 bp, rice(Oryza sativa)
  misc_feature (71): n=a or g
gatgcagaatcaacttcacaggtgaagtaggattttatgtcaatctttcctacctgtcttctgctggctanaaaaactaattatttcttcaccttttccat

SEQ ID NO: 56712 - DNA, 101 bp, rice(Oryza sativa)
  misc_feature (71): n=t or c
aggagacgatcctggcgtgcgacagcatgggcacggagggcgtggtctcgatgtactcgaccctcttctgngcgagccagtgcagcgccttgacgagcagc

SEQ ID NO: 56713 - DNA, 101 bp, rice(Oryza sativa)
  misc_feature (71): n=t or g
ccggtatgccctcccaacttttattcgcacatgccaagtgccaacaggttttctatatatattagagtatngtctgagcttgtaataggttctcttagcac

SEQ ID NO: 56714 - DNA, 101 bp, rice(Oryza sativa)
  misc_feature (71): n=t or c
agaaacaacagagtatgcatcagcattcaacaatgaaatgtgactagtaaactttgcaatgatctgttagnaattgttgtccttccttcgtctctacggct

SEQ ID NO: 56715 - DNA, 101 bp, rice(Oryza sativa)
  misc_feature (71): n=a or g
tgaagaaaaaattgggaactaaacaagggcttcgttccctatctagatgttctcgttttgctgatgaactncgggtgtgtttagttcacgctaaaatttaa

SEQ ID NO: 56716 - DNA, 101 bp, rice(Oryza sativa)
  misc_feature (71): n=t or c
acagcctcccaataggattggtcgttgcctcaacccatagtcgcccttcttgcataatccgcttcaccatngttggcactgtgatagaacaccgtcaaaaa

SEQ ID NO: 56717 - DNA, 101 bp, rice(Oryza sativa)
  misc_feature (71): n=t or g
ttatgtatgcagccattatgttggtgtgctttgacaaccaggatcattatttgcaggatggatttcagaantttcacttctagtgtaaatataaaaatttg

SEQ ID NO: 56718 - DNA, 101 bp, rice(Oryza sativa)
  misc_feature (71): n=a or g
gaagtcctttttttagacaaggagatagtagcgtgcaagaaaactactggaataagtttcattataacacnctcgtatatatacgatatagttgcaaataa

SEQ ID NO: 56719 - DNA, 101 bp, rice(Oryza sativa)
  misc_feature (71): n=a or g
tcgtatggaatctactaaaggtgtgataaggctaactgttttgtaacttatggctagttgaagttgaatgnttggctttgacatattaacatcattggcag

SEQ ID NO: 56720 - DNA, 101 bp, rice(Oryza sativa)
  misc_feature (71): n=a or g
tcctggattgtatgtgctctgttttgagtgaattgtgtaataagtggctaatttcatcgaagcaaaggctnggatttaggtcctatttagatcctccaaaa

SEQ ID NO: 56721 - DNA, 101 bp, rice(Oryza sativa)
  misc_feature (71): n=t or c
ttcttgctgctcggagatgccgcggattccgctgatcaagttccccaagaggaatctcaagatcccatccncacccccaccaggtgctgctctctttcttc

SEQ ID NO: 56722 - DNA, 101 bp, rice(Oryza sativa)
  misc_feature (71): n=a or c
attatggataattttcctcttaacactgacaatagtttcagcagaccatggatcctaaactatgtgaccgnagaagcaatacgaagggcacaggaggagga

SEQ ID NO: 56723 - DNA, 101 bp, rice(Oryza sativa)
  misc_feature (71): n=a or g
cgctttgagcaaatgtctggtcctacagcttgcacaacgcatcatctcgtgagaacgcttaaaccattatngcgatagcagtgcaggcaccgatattgagt

SEQ ID NO: 56724 - DNA, 101 bp, rice(Oryza sativa)
  misc_feature (71): n=t or c
ccaagaagcagcgcagggcacattaagcattgatttcctttttagcatcagagttggtgggtcccaacgcngccctttcctgcttttttttttggttcaaa

SEQ ID NO: 56725 - DNA, 101 bp, rice(Oryza sativa)
  misc_feature (71): n=a or g
aattcaaaatttaatccacttcttgtagtggaaacgaacgggagagtgtggaaacggactatagtccatancagccaaatagaggcaaaacatgattacat

SEQ ID NO: 56726 - DNA, 101 bp, rice(Oryza sativa)
  misc_feature (71): n=a or g
actgttcgcgtgttttttcttgcctttcttcacatgtattatataaattagcacatcttttgatggtgatntacatttgcacaatgctatgtcgacctcat

SEQ ID NO: 56727 - DNA, 101 bp, rice(Oryza sativa)
  misc_feature (71): n=a or g
aagacgatgtggaagtcgtttgatcaacatccaacggctgagatcgtcgaccgataataatgaaaagaganaagaatcctccgcagcgtcgcagctgaaga

SEQ ID NO: 56728 - DNA, 101 bp, rice(Oryza sativa)
  misc_feature (71): n=t or c
cttgaggtaatggggttgtttaatcggctcctccagcctgcatgcactactacggaaagacacatacaggncagcactataggtcctgaaacggctaaaat

SEQ ID NO: 56729 - DNA, 101 bp, rice(Oryza sativa)
  misc_feature (71): n=a or g
agaatgattcatgactctttactagaagagagaagtgagaatatgacaggttctgcacatgctaaggttgnacacaacaattaaatcatgaagtggtaagc

SEQ ID NO: 56730 - DNA, 101 bp, rice(Oryza sativa)
  misc_feature (71): n=a or g
ttttgaaggtgccacagacagtcagacacccgcatgcgataatcattctcatcgaacaaaaaaaaacatcnccgccgctctccccggctccttcttcgggc

SEQ ID NO: 56731 - DNA, 101 bp, rice(Oryza sativa)
  misc_feature (71): n=t or c
ccttcggatggagttggagtgaactccaaagcatccccacccgtactcttccctttccattcccaactcanatttcttgtttttcgcgtgcatgttttttt

SEQ ID NO: 56732 - DNA, 101 bp, rice(Oryza sativa)
  misc_feature (71): n=t or c
cgcgcctgcgagccttggccaggattgtgatggttttcttgttctttcgatcgtgatgttttctttggtgntgccctgctgccgctggatgttgaccgagc

SEQ ID NO: 56733 - DNA, 101 bp, rice(Oryza sativa)
  misc_feature (71): n=a or g
gatgttacaggctaaaaaaatttgccgggataaatttgccgggatcttaaacagaccgtaaagattcgatnttacaggctgaaaaaggcctggagtcacat

SEQ ID NO: 56734 - DNA, 101 bp, rice(Oryza sativa)
  misc_feature (71): n=a or g
cttcacagaacattcaatttctccatggccatgctctcaacaatcatttgatcgacagcttgcgtacaagncactaaatggcacgtttctagccggccggc

SEQ ID NO: 56735 - DNA, 101 bp, rice(Oryza sativa)
  misc_feature (71): n=a or g
acgctccatcaacgcgacatggggacggccatcttcggcagatggtgatcagttggtgaggatgaggaccnctcggccggcagcgccggcgacgtccatgg

SEQ ID NO: 56736 - DNA, 101 bp, rice(Oryza sativa)
  misc_feature (71): n=a or c
tttagatgatcttagttttttttggaagtttagtaggatggcctggtgggataccattctatatgattatnttttttcttaggtttcacatctgcctcttt

SEQ ID NO: 56737 - DNA, 101 bp, rice(Oryza sativa)
  misc_feature (71): n=a or g
ttggatagcgagaaaatactagcacaacaaagaatttgagacacggcaccgagcgtgcaatcaattcgatnataatattagttgatgctaaatatggaagt

SEQ ID NO: 56738 - DNA, 101 bp, rice(Oryza sativa)
  misc_feature (71): n=t or g
caatctgttggctcgattttgttctggaatcctttgccacctagtaaattagttggcacctcgatattgcntttgcgacatctggttaattaaaagatgta

SEQ ID NO: 56739 - DNA, 101 bp, rice(Oryza sativa)
  misc_feature (71): n=t or g
tctctaaattccctgaaggacgtcaattgtgaacactagagtttgctacgtgaatgtatgtatggtagggncatgtataggcaatagaggtgcccagtgag

SEQ ID NO: 56740 - DNA, 101 bp, rice(Oryza sativa)
  misc_feature (71): n=t or c
atagagcatacgaaagtgatggtcagcatgaactcttgtggtcaaaccggctactgggactgtaggtcttngtacatttcatatgaaacatacggcctctt

SEQ ID NO: 56741 - DNA, 101 bp, rice(Oryza sativa)
  misc_feature (71): n=a or g
agcgaaatatgtcagtagctagcagcgatccgataagtgataatttagtggtgttttcacgcatggctcgntgcagcgtctcccgtgttgtcttgttgctc

SEQ ID NO: 56742 - DNA, 101 bp, rice(Oryza sativa)
  misc_feature (71): n=a or g
tgacagatgatggcatgttatttacttgtctcataagtctccttactccaacccgtagctcaccactttcncccctgaaagttattcaacgatatttagcg

SEQ ID NO: 56743 - DNA, 101 bp, rice(Oryza sativa)
  misc_feature (71): n=a or g
tagctctctcttgtctaatctgtttctttgaaatatcgccactttttaggcttttagggttctagagcttngaccttgtttctatattattctctctcttt

SEQ ID NO: 56744 - DNA, 101 bp, rice(Oryza sativa)
  misc_feature (71): n=a or g
ttttctttgggacgccttgcattgcgctgcgcatgtgggataacctttttttttttactactgtacatttntcgacaaattttctcctaaaaaattgacag

SEQ ID NO: 56745 - DNA, 101 bp, rice(Oryza sativa)
  misc_feature (71): n=a or g
tacccccgccatttgcgcccctgcccttccccctccttaaaatgttgagcaggcggcagccggttgctacngcgcggcttagcgaggagacgagccgcggg

SEQ ID NO: 56746 - DNA, 101 bp, rice(Oryza sativa)
  misc_feature (71): n=a or g
aaaccagcgggaaaaaaacccactccatgtatagctatgtctagctggcgtgtggcagctctgtgtattantctatcttacagttcgcactgcatcaacaa

SEQ ID NO: 56747 - DNA, 101 bp, rice(Oryza sativa)
  misc_feature (71): n=a or c
tgtgttttatttgttcttctataggtactactgtagtactgtaccagtactacttttgatgctaccaattntactttctgtgccacgatttattcttatat

SEQ ID NO: 56748 - DNA, 101 bp, rice(Oryza sativa)
  misc_feature (71): n=a or g
catattgaaaaaaaaaattataaaaacgaagaggaagcggaggcgtagtaagaaacgtaggggtgaaaacngagcggatattatccgatccgatccgctct

SEQ ID NO: 56749 - DNA, 101 bp, rice(Oryza sativa)
  misc_feature (71): n=t or c
gtcagtaccgcgcgcacacaatcaacatgaccaaaaagcatcagatgccgctagggatggcaatcgggtgngacgggtacgggtagtgcctatccataccc

SEQ ID NO: 56750 - DNA, 101 bp, rice(Oryza sativa)
  misc_feature (71): n=t or c
agagattacaaatatgcctatcttatctcaacgcaactctatcaaaaatgataccagaatgacacaccctncttctccatttatacccaacgtaagcagcc

SEQ ID NO: 56751 - DNA, 101 bp, rice(Oryza sativa)
  misc_feature (71): n=a or g
attactccatccgtacttaaatataattaacagattttgattggatgtgaccgtctagtacaacgaatttnaatatttttttagatttgttgtactaggat

SEQ ID NO: 56752 - DNA, 101 bp, rice(Oryza sativa)
  misc_feature (71): n=a or g
cggattataggctatggtggtggtgttggcactatgattcgaagccttggacctatttataccatggatcncctttatctccaagtagaacttagagactt

SEQ ID NO: 56753 - DNA, 101 bp, rice(Oryza sativa)
  misc_feature (71): n=a or g
tttatgcatgtgtatatatattgctatatagataaaattggtgccgattatagacccaaaagcaagaggtntataatataatacagaccacacgaccaaac

SEQ ID NO: 56754 - DNA, 101 bp, rice(Oryza sativa)
  misc_feature (71): n=t or c
gactcatggccaagcaggcctttatatgttactgcaacctaaaagatgatacatcaatataagaactgggntataaaatgaccaccttatataaaaactaa

SEQ ID NO: 56755 - DNA, 101 bp, rice(Oryza sativa)
  misc_feature (71): n=a or g
aagagtggcaaatagttaattattccgttgacggagctcctctgcaatcagcatgatctcattttcgaganttacacaaccacttaacatgatcaaggaat

SEQ ID NO: 56756 - DNA, 101 bp, rice(Oryza sativa)
  misc_feature (71): n=t or g
ttcaatatgtagaatgaggataaacagatctcatgaggatatacaaaattgtgtcgcttatcacattagtnaaaaggaaaatattttctcactaaatcaac

SEQ ID NO: 56757 - DNA, 101 bp, rice(Oryza sativa)
  misc_feature (71): n=a or g
ttctcgaatatgacgaccaaagtggcatgaataagacttggagacctgtcgctgtcctcctcgagctcccntgcaaggaccagcctcgccaaggtgggccc

SEQ ID NO: 56758 - DNA, 101 bp, rice(Oryza sativa)
  misc_feature (71): n=a or g
gaaaaaaacactttcccatgcttatactggtcatcataaccagtctgaaattaaggaaaggttgagaatanaacaattaaaaaatccctcctaactcaact

SEQ ID NO: 56759 - DNA, 101 bp, rice(Oryza sativa)
  misc_feature (71): n=a or g
cacaggaccctgtagcgatcatggatctgggtacccacacgacaggcataattaatggctatgaagggagngtgggcctgatctaggagatagaaggtaga

SEQ ID NO: 56760 - DNA, 101 bp, rice(Oryza sativa)
  misc_feature (71): n=a or g
ctggagggaggagcgtcgcgagaaggtttcagttttggtgaaaataatcacagataccaaaaaggcgtagntgtattattaataaacaaaataaaacatca

SEQ ID NO: 56761 - DNA, 101 bp, rice(Oryza sativa)
  misc_feature (71): n=t or c
gtcatgcacggggcaccgaagctcatgcatcctgcactttggatcatcattggacccatcgaaaatatagngaatcgaatataaaagttgaactcagattg

SEQ ID NO: 56762 - DNA, 101 bp, rice(Oryza sativa)
  misc_feature (71): n=a or c
cggtctcaaattctcaattcggaagtgcctaacctttgtgctttcggctacaatatagtaaaattttgctntatatttatcgataaattttctataaaaaa

SEQ ID NO: 56763 - DNA, 101 bp, rice(Oryza sativa)
  misc_feature (71): n=a or g
atcattggagcaacctgcactcgccatcctggataagtccatccgccttccatgtcaaacgggcccctacncacagttctggccaccccaagctcgtggtg

SEQ ID NO: 56764 - DNA, 101 bp, rice(Oryza sativa)
  misc_feature (71): n=a or g
gagttgtgataaccagcgtcaccaacagcaacgatgttggaatcgctctcttcagtcaatggagaattcanctgaactgcacgtcgacctctgatagtgtt

SEQ ID NO: 56765 - DNA, 101 bp, rice(Oryza sativa)
  misc_feature (71): n=a or c
tgagcatcacacacacacgtaataaccacataggttcgtcaagctagattgcttataacactgcatacacnagtggacacgtcagaagtaagaagtgacaa

SEQ ID NO: 56766 - DNA, 101 bp, rice(Oryza sativa)
  misc_feature (71): n=a or g
gataggtgggtccatatttttttaataaataatatgttgactggattgtcacgtgtatgtcgcgtacatcncgtaggtaatttgttcggtattgaaagttc

SEQ ID NO: 56767 - DNA, 101 bp, rice(Oryza sativa)
  misc_feature (71): n=t or c
tactcttttactacactactactccatccgtcaaaaaaaaaacctttgagggatgtgattcagtttatctnttttttgacagagggagtacacatttatat

SEQ ID NO: 56768 - DNA, 101 bp, rice(Oryza sativa)
  misc_feature (71): n=a or g
cgtgcttttcaccatgctcttcggatcgatcggatccctttttttctacctagacaagcgcacacaagctntctgctctttgtttatgtcatcaagagggc

SEQ ID NO: 56769 - DNA, 101 bp, rice(Oryza sativa)
  misc_feature (71): n=a or g
catgctagacctggttatcatcaaggttgtgccacattccactggaagttcgaacgaagcaataataatgncctgactgagtgttccaaccagcatgaacc

SEQ ID NO: 56770 - DNA, 101 bp, rice(Oryza sativa)
  misc_feature (71): n=a or g
ggtcactccatcactgtagagagatgtacaaagaatgaaccgtacgtgtactacagtagggttatgtggcnaccgaatggtgcattagagagcggtgaatc

SEQ ID NO: 56771 - DNA, 101 bp, rice(Oryza sativa)
  misc_feature (71): n=t or c
gtattgtcagtgaaaaaaaaaacttgcctgtggaactctgatgatctcacaggggactttcatttctttcngtgcttgctgtgcaccttggtaattcatcc

SEQ ID NO: 56772 - DNA, 101 bp, rice(Oryza sativa)
  misc_feature (71): n=a or c
tatcatatgtaaattaaatatgtcgatcgatcgtgatgatcatgatcggccatgcatggacgtcgtacgtncgtacgtacgttcctgtagaattagacact

SEQ ID NO: 56773 - DNA, 101 bp, rice(Oryza sativa)
  misc_feature (71): n=a or c
atggcagattgccaggttaggtaacgtttgcggttcggagtgaagcacatgagactacaagaggaaacacnctacgctatcgttaagcagcacactgcgct

SEQ ID NO: 56774 - DNA, 101 bp, rice(Oryza sativa)
  misc_feature (71): n=t or c
cagccgtttacattgtgtgcaacagtagtagctgtttgaaaacttgcaaattgatgtttttcatcccctcnttatccctcgtactaaacaattgaagaaac

SEQ ID NO: 56775 - DNA, 101 bp, rice(Oryza sativa)
  misc_feature (71): n=a or g
cgatcgatcgatcacaacattttcttgaggtcgatcagtagtacccatggccggtggtggaggcgccgtcngagaacactacatgcgggtgatccgcggcg

SEQ ID NO: 56776 - DNA, 101 bp, rice(Oryza sativa)
  misc_feature (71): n=t or g
atctatactatacggcatggcatctcatcactcatgtctaatcttctcctctatgtacgtactttggcctncctgcctgctgaataaatatgcgttgaatt

SEQ ID NO: 56777 - DNA, 101 bp, rice(Oryza sativa)
  misc_feature (71): n=a or c
ggatcctagcatgggagtgaggctcgattgggttcatggggtaaaactatactttcatagttgtttctttntccaattcctctgaatataataaaatagtc

SEQ ID NO: 56778 - DNA, 101 bp, rice(Oryza sativa)
  misc_feature (71): n=t or g
actaagaaatggttcaaccttgctcgtattcctgcaatctcctgtcaacctcctctacatctgcagcctgncgtagaattccttccacctttatccctaca

SEQ ID NO: 56779 - DNA, 101 bp, rice(Oryza sativa)
  misc_feature (71): n=a or g
atatggttgttccaatccacttaggtttaagaaccaaactaatggctctttatttgatcaaggttgtatcntacttgtcggagcccgagctcctctggcgg

SEQ ID NO: 56780 - DNA, 101 bp, rice(Oryza sativa)
  misc_feature (71): n=t or g
tgccaaggaagaaaagagaatgtgcacaagctttgctatgtttccagctactgtactatatcccttttcancagtttaccaattacttcagaagagctcgg

SEQ ID NO: 56781 - DNA, 101 bp, rice(Oryza sativa)
  misc_feature (71): n=t or c
agcacaccattccaagaaattaaataccatcgataaatccaacttgctagaaatgctatcgtacaagcgtnttaatttgtctcagaaataccatcgcggtt

SEQ ID NO: 56782 - DNA, 101 bp, rice(Oryza sativa)
  misc_feature (71): n=a or g
ctccgtctccgccgccgcacccacgtccgctgtcgtcggcagtggcggatctagaaaaaaaaatagtagtngggctgaataaactacatcagcataaatcg

SEQ ID NO: 56783 - DNA, 101 bp, rice(Oryza sativa)
  misc_feature (71): n=t or c
ttctatgaattatattaagcaagacacttcttccgcggtacacaattaatgtcatactcatacccttcatnggtcggctcggtttgtaccaacatttctag

SEQ ID NO: 56784 - DNA, 101 bp, rice(Oryza sativa)
  misc_feature (71): n=a or g
ataataggccaaatttggtttggttcggaacttcggatttagtttctgtttataccaagttcatgctcttnatgcattcatgtggcaatttaaatatttaa

SEQ ID NO: 56785 - DNA, 101 bp, rice(Oryza sativa)
  misc_feature (71): n=a or g
gagatgtgggcggggctcgggtattaccggagggctcgatttcttctcgaggtgagtagtgagttgattgntcacgaattcactgtcgaaacgacggggat

SEQ ID NO: 56786 - DNA, 101 bp, rice(Oryza sativa)
  misc_feature (71): n=t or g
ttattatgcagtgtaaatctgcagctccaattttcattcttctgtttgcctttttgtttaggtaagctatnctgttgatttcttttcaacagtgtatacac

SEQ ID NO: 56787 - DNA, 101 bp, rice(Oryza sativa)
  misc_feature (71): n=a or g
gaaagccttgtgtgtataagaacatatagccaaaagtttggtctcaatgtccatacaacatactccctccntcccataaaaaaccaacctagtaccggatg

SEQ ID NO: 56788 - DNA, 101 bp, rice(Oryza sativa)
  misc_feature (71): n=t or c
cattaaccagcttttgaattcttacttttgtttgttgaaaacttgcaacaccattaggctgtcggtttccnggatgggctagtgctggaaaaaaccttggt

SEQ ID NO: 56789 - DNA, 101 bp, rice(Oryza sativa)
  misc_feature (71): n=a or g
cagtataacaaaatagtactccatccgttccagaatagattcattaacatcaaatataaatataaaaaatnctataataacttacattgtgaaatgaagga

SEQ ID NO: 56790 - DNA, 101 bp, rice(Oryza sativa)
  misc_feature (71): n=a or g
ttttaccaagacatttaaccagcgagaacaacctctccaagcccatatacacaaaattcgagctaataaancacacattataatagtttctagtacacaat

SEQ ID NO: 56791 - DNA, 101 bp, rice(Oryza sativa)
  misc_feature (71): n=a or c
tacacctgcatgcatagtactaaggtgctgcctagaaaaatatatttttccagacggaaccttaagcggtncgtctgagaagatagatattcctaagtgga

SEQ ID NO: 56792 - DNA, 101 bp, rice(Oryza sativa)
  misc_feature (71): n=t or c
tgacgctcgctgttgccgacaagtcgtctctatcgccaaatctttcccattccaaacttcccacatcatgncgagcaaatctccttttgaccccatctcgt

SEQ ID NO: 56793 - DNA, 101 bp, rice(Oryza sativa)
  misc_feature (71): n=t or c
caaaccccgacaggggtcgacgaaatcggatagacttttggcctgatgttcttgaagatcattagttttcnatatacatttctgtggaaggaactggctgt

SEQ ID NO: 56794 - DNA, 101 bp, rice(Oryza sativa)
  misc_feature (71): n=a or g
aacggtgaggagaacgagagcggcgaccggtgtggctaatcggcacgtacgggggcgagagctgtcaagancgaagtgtataaggccattcccaacccaat

SEQ ID NO: 56795 - DNA, 101 bp, rice(Oryza sativa)
  misc_feature (71): n=a or g
ttaattcggttgaactaattagaacaaatatatgcaggtgaaaatgcaaagatttttctgaacattaaganataatagataaaaaatgcccatgcattgca

SEQ ID NO: 56796 - DNA, 101 bp, rice(Oryza sativa)
  misc_feature (71): n=a or c
cgctacctcgtggagtcccgagacgagctgctcatggtcgtcaggttgggtacccgtaagtcatgtactgntcgacctcgccgtggccgctcgcagtagcc

SEQ ID NO: 56797 - DNA, 101 bp, rice(Oryza sativa)
  misc_feature (71): n=t or c
aaaaactttcatgtgcaaactttttaggcctttcacagtgctccacctagagcgttacttcatgcgtccanataagctgcgtgatggcgtggaagaaagag

SEQ ID NO: 56798 - DNA, 101 bp, rice(Oryza sativa)
  misc_feature (71): n=t or c
aaattttaacgttttgggaggatttacggttccatgcatagatttgatcagcactcccaagttgtgtattnaaactgaattttgggtatcagcacaattaa

SEQ ID NO: 56799 - DNA, 101 bp, rice(Oryza sativa)
  misc_feature (71): n=t or c
tagtctaacaccaaccgggactaaagatcaaaaaatagctcgagttttttgaaccaagactctttagttcnggtttttattgcaaccgggactattgtgga

SEQ ID NO: 56800 - DNA, 101 bp, rice(Oryza sativa)
  misc_feature (71): n=a or c
ccctccagtttatattcaataagaggatctcgttgggtgtaacccctcaaaccaacagctttgttgcatanacttctaccgttctacgcctgcaagtgttc

SEQ ID NO: 56801 - DNA, 101 bp, rice(Oryza sativa)
  misc_feature (71): n=a or c
tttgacgctcatcacctcaatgccattatatctattggtgcaaacatggcgagaaaggcatccagagcgangagaggaaaataatcgaggatagggaaggg

SEQ ID NO: 56802 - DNA, 101 bp, rice(Oryza sativa)
  misc_feature (71): n=t or g
gttaaaagtcttacgttgcaaccgaaagtattaaaggtagctgggaattcacccctccccagcaatttttnactagcgtggccccctgtaggtgctgatat

SEQ ID NO: 56803 - DNA, 101 bp, rice(Oryza sativa)
  misc_feature (71): n=t or c
taatattaggtattgaattactgaaatatgctccaagaggatatcttctgcatgatggacatgtaataatnggtagaaactctggagattaatttaataca

SEQ ID NO: 56804 - DNA, 101 bp, rice(Oryza sativa)
  misc_feature (71): n=t or g
atcactttctagagagggagacgagttgttgctcgaagtccctcgctcacttcaaaaacaactacctactntagcatatggatccgatatttcgtggaacc

SEQ ID NO: 56805 - DNA, 101 bp, rice(Oryza sativa)
  misc_feature (71): n=a or g
gagtagagaccacagctttgcttttggatcttgcccagtgggttagcaagctcacttgctcatcagctctntttgcctaattgctcggcaatgttttgaaa

SEQ ID NO: 56806 - DNA, 101 bp, rice(Oryza sativa)
  misc_feature (71): n=t or c
aaccctcacaaaagcaagctctagtagtggttgttagaacaaagggaggagttgtttctgaaagttggggnggtctgaactctgaaattttctttgttctt

SEQ ID NO: 56807 - DNA, 101 bp, rice(Oryza sativa)
  misc_feature (71): n=a or g
tggtatcagccaaaatatcaataagccccaaacagtaataatgtgaacttaattgtccaaaggggccaatncaacagaaatctcagtgagcccaaatgtat

SEQ ID NO: 56808 - DNA, 101 bp, rice(Oryza sativa)
  misc_feature (71): n=t or c
atgttacatgtctcgatttggaatctaatatcatcatgatctcgattgatttctcttaatttcaacacctntctctctccataaccaggagattactacta

SEQ ID NO: 56809 - DNA, 101 bp, rice(Oryza sativa)
  misc_feature (71): n=a or g
aactgaatagagtgtaatcctagagattctgatatgtaaagggattggcaactgtggattgattgggtagnaaaaaaaatctaaaaatctacaactttttc

SEQ ID NO: 56810 - DNA, 101 bp, rice(Oryza sativa)
  misc_feature (71): n=a or g
gggatttatggaactaggatggtttggattgtgcgaattatttcattattgatttatcttataactgcctntcgtggatgttcgtatttataggggagact

SEQ ID NO: 56811 - DNA, 101 bp, rice(Oryza sativa)
  misc_feature (71): n=t or c
tacagcagccgtcgtaaagtggtaaggaaagtgattgatatgccctgattcgtttcactcgatcatgccgnttatatataccgacgtgaaggaaatggttt

SEQ ID NO: 56812 - DNA, 101 bp, rice(Oryza sativa)
  misc_feature (71): n=t or c
caacgatcgcacaacatcctcttgaatttgggccaggcctagcattgttgatctaccaattgagctattgnctattagctgatgttgtgttgtattactat

SEQ ID NO: 56813 - DNA, 101 bp, rice(Oryza sativa)
  misc_feature (71): n=t or c
caagtgctctaggatccactctcccctcagttccaccgagtgttcgagcgcaagccatttcagtgatgganatgcccctcttgacaaaagcttgggtacaa

SEQ ID NO: 56814 - DNA, 101 bp, rice(Oryza sativa)
  misc_feature (71): n=t or c
atacccgtgaggagcctcaaccgttgagtccaagcctatacctttcacatactaaaattcaacctttgagncctcacacgagccttgggaaccggagaaag

SEQ ID NO: 56815 - DNA, 101 bp, rice(Oryza sativa)
  misc_feature (71): n=a or g
tacgtacatgcatccgactgtcctggttgtgtccttcgctgaaaagtactcagctatcagctaaaaaaaangatcaaatatataactgtagccaagaaaga

SEQ ID NO: 56816 - DNA, 101 bp, rice(Oryza sativa)
  misc_feature (71): n=a or g
atgatttcattaatatggagaaaataaggtgggagaaataaggaggcatctggttcaatggctaaaaacancaaagaaaaggatgtaatagcactattgaa

SEQ ID NO: 56817 - DNA, 101 bp, rice(Oryza sativa)
  misc_feature (71): n=t or g
aaaacacctgttgggcttgctcgagattggaaggtatgaacttgttatgaacatacctgattctttactancttaagtacgcacttcacttgttacccgct

SEQ ID NO: 56818 - DNA, 101 bp, rice(Oryza sativa)
  misc_feature (71): n=a or g
ggttctggtgtgtaagatgacacaggttatagctggaccgaccgacccaccctatccaataggtaagtccnttcattgtaaaaaaaacacaaaacgatgat

SEQ ID NO: 56819 - DNA, 101 bp, rice(Oryza sativa)
  misc_feature (71): n=t or c
gtagtagctgcctagctcgggtggataacccaaccattgtactcccttgcatctacttttgatagttcttncattctaaaatataaggcataactacccct

SEQ ID NO: 56820 - DNA, 101 bp, rice(Oryza sativa)
  misc_feature (71): n=a or g
cttgaggcttgagcactgtggagtatgggcttttcggctcagcaaaaggaaacgttatggacattgccttncgccgacgagcggtaggctctccaaggcca

SEQ ID NO: 56821 - DNA, 101 bp, rice(Oryza sativa)
  misc_feature (71): n=a or g
ccgtatgtgaaaatttggctatttttcacactagcatcttaaacggccacacaggaaaaggtattttcgcntgaagacctcttgaaggtccgcccaaaagt

SEQ ID NO: 56822 - DNA, 101 bp, rice(Oryza sativa)
  misc_feature (71): n=t or g
ggaagaggaacctcctcactatatgggtggtgaagtggtcatctctattggcgctgacacataatagttgntggtgttgtcgacgataacctcgtggcact

SEQ ID NO: 56823 - DNA, 101 bp, rice(Oryza sativa)
  misc_feature (71): n=t or c
caatacgaaagttgcttaaaaaaatcatatttctaatttttttatcacgtgctaaaaaaaatacttcctcngtttcacaatgtaagtcattctagcatttt

SEQ ID NO: 56824 - DNA, 101 bp, rice(Oryza sativa)
  misc_feature (71): n=t or c
gcaatttatcaccgagatagtcagccttggttgcctccaacaccgcaacctagcttgtgcaactacttggntattgtcgacgcagtggtgaacttctcctg

SEQ ID NO: 56825 - DNA, 101 bp, rice(Oryza sativa)
  misc_feature (71): n=t or g
aggaggtgaaggcggcggcggcggcgtaggtgtcggagtcggcgaggtatttgtacgtcggcgggaagctnatctgcccttcctcccatcccccgaacacc

SEQ ID NO: 56826 - DNA, 101 bp, rice(Oryza sativa)
  misc_feature (71): n=t or c
tcaacttctcatctgtgaaatgacacgtgcagtgacctgagtaacattttaaggttacgagtgcaaatctncttaggaacgaatttcagattggattgttt

SEQ ID NO: 56827 - DNA, 101 bp, rice(Oryza sativa)
  misc_feature (71): n=t or g
ggaggttgtttcttttaattcttgaaaggcaagaggcttatctataaaggtgaaagtagttctgattcgtnagatggagtagctgataggggtagggacct

SEQ ID NO: 56828 - DNA, 101 bp, rice(Oryza sativa)
  misc_feature (71): n=t or g
agtgcatacatatcacatcctatcacatcttgaactaacgtcaaggcatccctccagttcaaaaactccanacatacacacccatatctgtccaagttagg

SEQ ID NO: 56829 - DNA, 101 bp, rice(Oryza sativa)
  misc_feature (71): n=t or c
gggatgttggaataatggaataagaaggtgagctcaaaacggatttcctgtacatgtttaacaagtgtatntgttgtaacctaacactggcgagtgagtga

SEQ ID NO: 56830 - DNA, 101 bp, rice(Oryza sativa)
  misc_feature (71): n=a or g
aactgttccgttctcgccaggaaatcctttccctttgctgattcctccactgtataaggatatttggtcantgcacgagaggaacacataaaaattccagg

SEQ ID NO: 56831 - DNA, 101 bp, rice(Oryza sativa)
  misc_feature (71): n=a or g
gtagtaaatttcgttcctacaaatcatgaaactggagtaaaagaaggcataaacatgagcagcataatccntactacagaaatcacatgagcataaaggcc

SEQ ID NO: 56832 - DNA, 101 bp, rice(Oryza sativa)
  misc_feature (71): n=a or g
gaaaggccaataattgtggccttttacagttatagagatatttttccatataattatccaaaatccccacncatttttgtagatgtttcttcattttcttc

SEQ ID NO: 56833 - DNA, 101 bp, rice(Oryza sativa)
  misc_feature (71): n=a or g
atggagtgccatcctttttaagcaatctggtacagttgggaaggggccccaagagatctatcgtgatcgtngcaccaccatccgtccaagtgtccatctga

SEQ ID NO: 56834 - DNA, 101 bp, rice(Oryza sativa)
  misc_feature (71): n=t or c
gggtggcttggagtggcgctgccccagccggtcgcgcatcatcttcaacatcgacatcagcaccctccaanagcaacaaagtgcgcccaacaccttctgcg

SEQ ID NO: 56835 - DNA, 101 bp, rice(Oryza sativa)
  misc_feature (71): n=a or c
agagaagaggtggaaatcacaaaataaaatcacatcacgtaggagatgagaggagaggtcgccggaccttntcctcgccgctgtggaggtcccgagctcgg

SEQ ID NO: 56836 - DNA, 101 bp, rice(Oryza sativa)
  misc_feature (71): n=t or c
tcttgtgtcttgttcttactaagatgagattattagtaatggattagtgacttctcctgcgtttgtagtgngtgctttacttatttatattctctaaaagg

SEQ ID NO: 56837 - DNA, 101 bp, rice(Oryza sativa)
  misc_feature (71): n=a or c
tgtatgtgaaaatgtaattctgcatgtgcatgtgcatgtttgtattgatttttttccacaaatgtgttctntgaggtctccatgaatcattatttttattt

SEQ ID NO: 56838 - DNA, 101 bp, rice(Oryza sativa)
  misc_feature (71): n=t or c
tcgggtactgggtacatataaacattttcttttgaaaaagataatgttacaccggggtgttcttgcgtacnccctccgtccaaaaaaaaaagcaaacccta

SEQ ID NO: 56839 - DNA, 101 bp, rice(Oryza sativa)
  misc_feature (71): n=a or g
catatgatattgatcagcctatcaaagggtagcagttcgcagttcgcagttcaaacacctatatttacatntagattagcatccactttaatgaacaagga

SEQ ID NO: 56840 - DNA, 101 bp, rice(Oryza sativa)
  misc_feature (71): n=t or g
ctgctccggtttggtaaataatgtaattttttttgatccgtttcgaaccttctatttcaaaagtcaactgntccttttttttagaacaaagtcaactggtc

SEQ ID NO: 56841 - DNA, 101 bp, rice(Oryza sativa)
  misc_feature (71): n=t or g
acacttgctcaagtacctaggtaacttggtactcatatcatagacaaatgactataagtggtcaattcatncaattgcaactatttaagagtacaatcatt

SEQ ID NO: 56842 - DNA, 101 bp, rice(Oryza sativa)
  misc_feature (71): n=t or c
cactgagcctggtcaggaattagctgtaagagccactctctttgttttacttcctttctcctttgttacgngctactgctcatataatccttgctatatta

SEQ ID NO: 56843 - DNA, 101 bp, rice(Oryza sativa)
  misc_feature (71): n=a or g
aaatatcggacgcccagccaggcaacgagtacatgtgagaaaatgctgcaaatcggcagcctggcggattngacgaaccctgtcactgtaacatacatgtc

SEQ ID NO: 56844 - DNA, 101 bp, rice(Oryza sativa)
  misc_feature (71): n=a or c
ataatatgtttgatcaagttgccttcgtccataactccatgtaccgtcgcctccctctaagcccggtcgcnaaccggcttggctctccctatgctgctgtg

SEQ ID NO: 56845 - DNA, 101 bp, rice(Oryza sativa)
  misc_feature (71): n=a or g
aaggcgcgagagagacgagagaagtgcgcgcttgggattttccaccgcgccaacaaaaaagaggagagatnggggctgggcctagagtccccaggattaag

SEQ ID NO: 56846 - DNA, 101 bp, rice(Oryza sativa)
  misc_feature (71): n=t or c
ataagcttctcgaatctagcatttttgctaccaattctgcccgggttgtcactagtattttgcttcctgtnctctttctctctaaagcctcagaacttata

SEQ ID NO: 56847 - DNA, 101 bp, rice(Oryza sativa)
  misc_feature (71): n=a or c
tgtgtgtgtgtgtggtgtgtactagtagcctagtagtggagatggtgtaagtgtaagcaactgcctcactntccccaaatctctctctctctctctctcta

SEQ ID NO: 56848 - DNA, 101 bp, rice(Oryza sativa)
  misc_feature (71): n=a or g
cagacagcaaagtattcatggtagtgtagtacgtatacgctgtatgctacgaacccagacttcacatgatnggtataactcactcacgtgttggcggtgtt

SEQ ID NO: 56849 - DNA, 101 bp, rice(Oryza sativa)
  misc_feature (71): n=t or c
ctacagatattacacacttaatatgagtttttttagtgagactaaaaatttatcgttggtcacaccctgtngtgggttttcccataaggttcttataataa

SEQ ID NO: 56850 - DNA, 101 bp, rice(Oryza sativa)
  misc_feature (71): n=a or g
tcagttataattaagtttggttagccaacggcattaacgtattgtccacgttccttcttctattttactcnctacttcccaaaatataacaaatttggatg

SEQ ID NO: 56851 - DNA, 101 bp, rice(Oryza sativa)
  misc_feature (71): n=a or g
tggaagataagggtttatacatgttttgatggattttatctgccggatgtattgctcatggtgatcttgcngtattgtttatgtcgatgtgccctttgagg

SEQ ID NO: 56852 - DNA, 101 bp, rice(Oryza sativa)
  misc_feature (71): n=a or g
atccatctgctccccagccccaacacgacaaataaaagccggagagagagagagcaggtataatagataancagttataaatatattttaaagagataaaa

SEQ ID NO: 56853 - DNA, 101 bp, rice(Oryza sativa)
  misc_feature (71): n=a or g
ccatacgcaaagaaagcccgtgagtcctgaaagtatgagtgactaacgtaaccctagagcctcagtcctcncgatcttgccctcgacgcctatcttatcaa

SEQ ID NO: 56854 - DNA, 101 bp, rice(Oryza sativa)
  misc_feature (71): n=a or g
agatgctgctgctgcgtgctttgtttgacctcactaatctcgcttttccactatggaagtctttctagctnctccctgcaactgtcctgtcctttgtgttt

SEQ ID NO: 56855 - DNA, 101 bp, rice(Oryza sativa)
  misc_feature (71): n=a or g
tacagatgcaggacatcaaatagttctccaaacagaatttgaccgcagcaacagaggcaagagtttgaaantggtatatattagcatagcttgcgcagcag

SEQ ID NO: 56856 - DNA, 101 bp, rice(Oryza sativa)
  misc_feature (71): n=t or c
tagtacttgcctagtgagatgactgttattttccaatgtactggagactcgaccttacaagtgtcgttacnaatcacttgcctccatctcaaacgtcttag

SEQ ID NO: 56857 - DNA, 101 bp, rice(Oryza sativa)
  misc_feature (71): n=a or c
aaaattttcgcatctggctagaggtttgtcatttgatgttatcgcatttttctaagaggggttatcatacnttttccctatatttcactaacaataacata

SEQ ID NO: 56858 - DNA, 101 bp, rice(Oryza sativa)
  misc_feature (71): n=t or c
aattactagaatgtttgctttggtggctgtatgctgatgctgcataagtaaagctacatgcaaaagtaatntgatcattttgatttgatacacgacaatta

SEQ ID NO: 56859 - DNA, 101 bp, rice(Oryza sativa)
  misc_feature (71): n=a or g
tccagacagcaaagcaaccgcagattcgccagtgatggacagaggtctgctgaaagcagccacatcgggtntgaagccggctctgcatgacccaagccttc

SEQ ID NO: 56860 - DNA, 101 bp, rice(Oryza sativa)
  misc_feature (71): n=a or g
tgccatgttgaagatgccagccccaacagcatcatctcacttcaggctgacatcaggcagtccttcgtgtncgacaaggaaagttgcgacaaggcccaatc

SEQ ID NO: 56861 - DNA, 101 bp, rice(Oryza sativa)
  misc_feature (71): n=a or g
caattgtcaattcttatattgcaagtatactggtaactagcattagtaacacatattatgtgctacgacanttcttcctataatactgtactgtttcacat

SEQ ID NO: 56862 - DNA, 101 bp, rice(Oryza sativa)
  misc_feature (71): n=a or g
aggaggcaacccacttgagtggagtagacctagaataactcctcagaagtcagtgcgtggcaatatgaacngttcagactgtccacctcaccactgctcga

SEQ ID NO: 56863 - DNA, 101 bp, rice(Oryza sativa)
  misc_feature (71): n=t or c
tcgcgctatacttatgtcctggcctacggattgatgattaagatgtagctttaagtacccacgtccagtgnatagggtgaaactgaccattatttgtgtag

SEQ ID NO: 56864 - DNA, 101 bp, rice(Oryza sativa)
  misc_feature (71): n=a or g
cacgcgatatcacgcaagtgagacaacccagagacgaccgaagaagaacagccgagcattgcaactgcganaccctaaaaccctataaacagtgaacaccc

SEQ ID NO: 56865 - DNA, 101 bp, rice(Oryza sativa)
  misc_feature (71): n=a or g
cgagaaaaccgtctgatttaacgcgagaaaaaacccatcatttctaaaatatggttagaaaaaactgttcnactcagtacgagaaaaaaaactgccgttta

SEQ ID NO: 56866 - DNA, 101 bp, rice(Oryza sativa)
  misc_feature (71): n=a or g
ttcaatagtagattttctaactgcttaggatttaaatggtggtggagtactgacatactacatacctgaantttatattgctttaggatctttatttatta

SEQ ID NO: 56867 - DNA, 101 bp, rice(Oryza sativa)
  misc_feature (71): n=a or g
ttaatagttacttcctctgtcccataaaacaattcattttggctattcatttgcatagccaaaatccctcntatcataggtcggaaagagtatgttcatga

SEQ ID NO: 56868 - DNA, 101 bp, rice(Oryza sativa)
  misc_feature (71): n=a or g
gattcactgcatctgcatctccctttcactgcatccacatcagggaaaaaaaattcaagaactcacatgcntagaggtcgacaggattgaagcagaagctg

SEQ ID NO: 56869 - DNA, 101 bp, rice(Oryza sativa)
  misc_feature (71): n=a or g
aacaaacgaaggaggtgttctccatgatacaatccaagagttccctatcttctaacgtcattttgtgtgcnaacaaacctccggcaaaaatattgagatac

SEQ ID NO: 56870 - DNA, 101 bp, rice(Oryza sativa)
  misc_feature (71): n=t or c
attttttctatgttaaaaatgtggctaaatttttgtacaaatttaatcaggtttgtggaagtttaacttangaaaaaacccaaaacatcttataatatgga

SEQ ID NO: 56871 - DNA, 101 bp, rice(Oryza sativa)
  misc_feature (71): n=a or g
aaaaacaacacttctttccatttcccagggaaatttttgtgcttgccctaaataattttttgtcaatctcntcacatggggtttccatgttaaaccagggc

SEQ ID NO: 56872 - DNA, 101 bp, rice(Oryza sativa)
  misc_feature (71): n=t or c
ccatttcatcgccaacttccagggtacttttgaatgccctggtacctagtttgatctttacaacgtcatcnagaagtccggagaatcccttcgagattaca

SEQ ID NO: 56873 - DNA, 101 bp, rice(Oryza sativa)
  misc_feature (71): n=a or c
aatgtcacacttatccttcctccgacgatttttggacacatgttgtgatccatccattccacacccccccncacacaccccctttacttgaagtgggaacc

SEQ ID NO: 56874 - DNA, 101 bp, rice(Oryza sativa)
  misc_feature (71): n=t or c
ctatggaatggacaatcctatagagattttggaggaaatttagcggagctttaacctcttggtatttttcntttgagtctatctctctcgtccaattccta

SEQ ID NO: 56875 - DNA, 101 bp, rice(Oryza sativa)
  misc_feature (71): n=t or c
tttaataattaatttgcatccactactatagaatcgatttttgcgaacgaatcctccaccaacttataganggaccataataacgtccacttgcaataata

SEQ ID NO: 56876 - DNA, 101 bp, rice(Oryza sativa)
  misc_feature (71): n=t or c
cagcgcttggttaaacagtctaaagtccctaaaacccaagccaccacaatgttttggtttggtgatacagncccaagatttccaatgtgctttcctcttcc

SEQ ID NO: 56877 - DNA, 101 bp, rice(Oryza sativa)
  misc_feature (71): n=t or c
tgtcctgtgttccctgagcgatgatgaacttggttggtgttgagatggtttgtcttggttaaatgggctgntgtgattcattgcttgtttcatttggtgtt

SEQ ID NO: 56878 - DNA, 101 bp, rice(Oryza sativa)
  misc_feature (71): n=a or g
cccattggtgtggagtcatggtgtttccaagtctgcatgaggaattggttgttgacgagctagggtgttanctttaggttgttttggtttggctgggtctt

SEQ ID NO: 56879 - DNA, 101 bp, rice(Oryza sativa)
  misc_feature (71): n=t or c
cacatttgctaggggaggagactgagcatcaagccggacatcttttggatcgcgggtagacttatgcagcnatgactgttctaaagctgaatagttgttac

SEQ ID NO: 56880 - DNA, 101 bp, rice(Oryza sativa)
  misc_feature (71): n=t or g
gaaataccatcctcgaccaaggtgtctttgctcaaataccatcctgggcgaaaatgccccttagctcttcntcttcctccctccctccctccaatcgctaa

SEQ ID NO: 56881 - DNA, 101 bp, rice(Oryza sativa)
  misc_feature (71): n=a or g
attgacatatatgaatttgagaaaagtggctgctagctagagctacactattagcaagttgcaaggtactnttgtctcatgccacaaggctgcttctgctt

SEQ ID NO: 56882 - DNA, 101 bp, rice(Oryza sativa)
  misc_feature (71): n=a or g
ttcaaagaagaattaattctacatttcctcatggataaattgttagcaacatatttaccgccctgagaggnctttgtttttctttccccatgcacgtataa

SEQ ID NO: 56883 - DNA, 101 bp, rice(Oryza sativa)
  misc_feature (71): n=a or c
agccaagaacgggagagacgtgcaggtggtcgaggcgcaacagatgtcaccgccggaccttgaggaggtgngccggatggtaggagcgtgacgcaaggacg

SEQ ID NO: 56884 - DNA, 101 bp, rice(Oryza sativa)
  misc_feature (71): n=a or c
aaaattgtcaatttttgcatgccattgcatacaggcagacggccggtccatctaggaagacaaattttggntgcctgcgaaaatggttttcctagtggtga

SEQ ID NO: 56885 - DNA, 101 bp, rice(Oryza sativa)
  misc_feature (71): n=a or g
gctcacgcagctgcatgtatttgttgcgctaggcctgcatatgctcttcgacatgagcaatttagtagagnaggaatgtggagaatcaaggtgtggtcaca

SEQ ID NO: 56886 - DNA, 101 bp, rice(Oryza sativa)
  misc_feature (71): n=a or g
atagtaagtgtcgcatagttggcaagagaggaaagcatactattgtatcccaaatcatgtaacaaaaggcnagtatccagattattgggatacggggcctt

SEQ ID NO: 56887 - DNA, 101 bp, rice(Oryza sativa)
  misc_feature (71): n=a or g
ggaagggggtgagcaattttttttctatttctgttggtagtttggggttgattcactttttattattattntgagtcaacttatatatatatatatatata

SEQ ID NO: 56888 - DNA, 101 bp, rice(Oryza sativa)
  misc_feature (71): n=t or c
ctaagtcctgatgtaagggtgtaagtggttaacccgtgagctcacttataaacaaacataaatcactaatncacttattttatctataaataaattcgtgg

SEQ ID NO: 56889 - DNA, 101 bp, rice(Oryza sativa)
  misc_feature (71): n=t or c
tatttaaattgtatatagtatttgtatgtatacttagaataccatgtcaggcagcctagcccaaaaacttncaaaatatatatgtgtttaaattcattaat

SEQ ID NO: 56890 - DNA, 101 bp, rice(Oryza sativa)
  misc_feature (71): n=t or g
aagtacaagttctcaaagaaacttctctctctaggaaacgaaggttggatgggtcggacgatcgaacggtnaatcatgtcacttcctatctttcgtttaaa

SEQ ID NO: 56891 - DNA, 101 bp, rice(Oryza sativa)
  misc_feature (71): n=t or c
gtctcgaggtcgtagttttttcgtttattggtggtatgttcttctctttggtaagatatgagtttaagtgntcttgtattcttttggctattttcttatgg

SEQ ID NO: 56892 - DNA, 101 bp, rice(Oryza sativa)
  misc_feature (71): n=a or c
ttcctcctgatgtacggaaatgatgtacttgctctggagtgtcttaattgtcatgaatagctttgcttagnaaaagtaactacccacataggaattataaa

SEQ ID NO: 56893 - DNA, 101 bp, rice(Oryza sativa)
  misc_feature (71): n=t or c
taggagacattagacagactaggcgtacaattgaaagacgtcaggtaaacttattcctttcgattatgtgnatttacagttggtgtagaaattgcactttc

SEQ ID NO: 56894 - DNA, 101 bp, rice(Oryza sativa)
  misc_feature (71): n=a or g
agccgaaggggttacccggggtcctcttgccccctgctgcatccaccagtgtctatctgattcgttccatntcagtgaaagttctttttttatgagaaaga

SEQ ID NO: 56895 - DNA, 101 bp, rice(Oryza sativa)
  misc_feature (71): n=t or c
atacactttaataaacctttatcttttctctatctacctgagtaaccacacataaaataaaacgaagcagnagcgctcccccttgctccctcgctcatcca

SEQ ID NO: 56896 - DNA, 101 bp, rice(Oryza sativa)
  misc_feature (71): n=a or g
aagggtgattgaagcgaagataaataataataataatcagaggttaactatcgctgggataattagtaccncagaaataatacttacattgtgtataaaat

SEQ ID NO: 56897 - DNA, 101 bp, rice(Oryza sativa)
  misc_feature (71): n=t or c
atatccaatactttgaaattcctatggaatggacaaccctgcgtttttagcaagaacttcaactttcctgngtttttcctgtggttcaatcaaacggttat

SEQ ID NO: 56898 - DNA, 101 bp, rice(Oryza sativa)
  misc_feature (71): n=a or g
ctacacatcgcattaaatgcgacgtgccgcgctagtgctgcctcaataaatgctgtaggtgggcgctgggngtgcccgcccaagccacacgcgcgagacag

SEQ ID NO: 56899 - DNA, 101 bp, rice(Oryza sativa)
  misc_feature (71): n=a or g
cttggcctcgacaaggaaatgcgagttgtgataatcaaggggagctgtgagggcacaagagttgacaaaantaaagaatgggcagggtggaggtgaaacac

SEQ ID NO: 56900 - DNA, 101 bp, rice(Oryza sativa)
  misc_feature (71): n=a or c
atacatatatgttgatatattgtcacatattccaggaaaaaaatattgtcgcatgctaaagaaataatccntaaagcatttttcttaaagaaaggtattcc

SEQ ID NO: 56901 - DNA, 101 bp, rice(Oryza sativa)
  misc_feature (71): n=a or g
gctggaaaaacgaagagctcggactagtactaggactaggtagtaggtagtatgaaggactgggaaggctnggtacctgtgattcccttgcttggttgatc

SEQ ID NO: 56902 - DNA, 101 bp, rice(Oryza sativa)
  misc_feature (71): n=a or g
aataaattatttttatcttcaatacattaacaatctcatcctcatatcattacatgaaaatatatcttgcnttagatatatttatttacttagcctatatt

SEQ ID NO: 56903 - DNA, 101 bp, rice(Oryza sativa)
  misc_feature (71): n=t or c
cttaggtacacatcaatgtcgttaccatgttgctttgggccttgaaacatacttcctcttcatgcatagcnaggggggaggttgtagatacacatcgtaac

SEQ ID NO: 56904 - DNA, 101 bp, rice(Oryza sativa)
  misc_feature (71): n=t or c
aatttctgaaaatgctggggatcgggtgcccgatgcggtggaaaaaaaatcaggccaccctcctcctccangcgcgcctccgcctcgcctcccacgtgtcc

SEQ ID NO: 56905 - DNA, 101 bp, rice(Oryza sativa)
  misc_feature (71): n=t or c
gacaaggtatcataggtaatcaataattataaaaggcaaggtataatagcaattaggtcaccctacccatngatagcatataaataaaagaatgcatgtgt

SEQ ID NO: 56906 - DNA, 101 bp, rice(Oryza sativa)
  misc_feature (71): n=a or c
acacgcagtacatgttgacataatcatccatgacgggcagttttaaaatgcccgaaagagatatagtcatntgtgggctctaaataaagattgatagagat

SEQ ID NO: 56907 - DNA, 101 bp, rice(Oryza sativa)
  misc_feature (71): n=t or c
agtgtgcatgagcttcgacattagttgctggctgcatgttagcgcgaaccaccactaacagagagttttgngtactagtgcaaagcttatagtaagaggat

SEQ ID NO: 56908 - DNA, 101 bp, rice(Oryza sativa)
  misc_feature (71): n=t or c
tcaaccctacgtgacatacctacaacatatgcacatatgcttgtatggatagttagattagtgactcaaangtgtatttttaaagtagagtgatctgtatg

SEQ ID NO: 56909 - DNA, 101 bp, rice(Oryza sativa)
  misc_feature (71): n=t or c
atctattctgatgctaactctattatctctagttaataccttttgcattctcttcatatttactactactnattaggaaaaactagaaagatagcccacgc

SEQ ID NO: 56910 - DNA, 101 bp, rice(Oryza sativa)
  misc_feature (71): n=t or c
agttagctataagcacgtgtggatgagataagagaagggagagacggaaagcggtcaacagatttgtagcnaactgcagtacggactccaaaatgttatgt

SEQ ID NO: 56911 - DNA, 101 bp, rice(Oryza sativa)
  misc_feature (71): n=t or c
gcggggaggggtgtgcggggaggatcgggagggagggaagcttgcggcttcgatttggcatctggaggtgnggaggggaaagatctgggaatgagagagag

SEQ ID NO: 56912 - DNA, 101 bp, rice(Oryza sativa)
  misc_feature (71): n=t or g
aagatcaacaccagcctactgtaacttgccctgctcctgatgatgtgcacgacggacagcgggatggacancaccaggtacgcagtaacagccgaattcgc

SEQ ID NO: 56913 - DNA, 101 bp, rice(Oryza sativa)
  misc_feature (71): n=t or g
cttataagaaataaagtggtcttttatgcaaaagccgaggagctgaactgcaaaatccaaggagcaaaatntaaatttgaagaattggcaggggccgcgcg

SEQ ID NO: 56914 - DNA, 101 bp, rice(Oryza sativa)
  misc_feature (71): n=t or c
agaagtatggaactatggatattttggacaatcaaaacaattttacatgtaattgggattacttctctttnttttttttcaaatttctttcccttgatgat

SEQ ID NO: 56915 - DNA, 101 bp, rice(Oryza sativa)
  misc_feature (71): n=a or c
tttgtgcgattcccacatgggcctaaggcccagcccaattagatgggcctggaccatgtgaaattaaaacngcacgctccgggttgatttttttttcattt

SEQ ID NO: 56916 - DNA, 101 bp, rice(Oryza sativa)
  misc_feature (71): n=a or c
agtacttctccctgctctggctgtggcgagagttctgtgagacacttgagagtgtagagctaatagaagcntttcaggtaatacatggaaccttgtccttt

SEQ ID NO: 56917 - DNA, 101 bp, rice(Oryza sativa)
  misc_feature (71): n=a or g
ggctgagtatagtagtagttaattagtagctcgatgatcgatgatggataagcggccgggaggccagcgcnctgccaaggaagaagtagagatagataggt

SEQ ID NO: 56918 - DNA, 101 bp, rice(Oryza sativa)
  misc_feature (71): n=a or g
tcctcttcttttggaagagagtttgtcgtacgagcgagtgggtatatgcgcgctgctcctatgaggacttnctctcaaagagacggcccatgcatctctat

SEQ ID NO: 56919 - DNA, 101 bp, rice(Oryza sativa)
  misc_feature (71): n=t or g
cggagagggcggcgaagggcaggaatggcacatctggccgactcatcatccctagaaagggaaatgggganggaggcgcacggggagacagatgcggctgg

SEQ ID NO: 56920 - DNA, 101 bp, rice(Oryza sativa)
  misc_feature (71): n=t or g
aagtctttagtttcaacattgtggccagcagaattgttgatgattctcctcatcatacccaacccaagatnacccagcctgtcatgccaaactctaaatga

SEQ ID NO: 56921 - DNA, 101 bp, rice(Oryza sativa)
  misc_feature (71): n=a or g
cctacaacagaatggtgtagcattcagccaatagaatgatgaccatattgttcgtttctccgacaagacgnagatgaaattttggatactcgtggcacgct

SEQ ID NO: 56922 - DNA, 101 bp, rice(Oryza sativa)
  misc_feature (71): n=t or c
tgagagtaatttgaaacggaggagagtaacaaattgcagagcacatatcatgcacacaccttcgcatgtangcattctgagaaccgctatagttctgactt

SEQ ID NO: 56923 - DNA, 101 bp, rice(Oryza sativa)
  misc_feature (71): n=a or c
gagacgacgacgagcgcgcgaacaaggcggcgctcacgttcgccctgctccgggcctgtttagattgttgntaaaataaaccttaccaaatttgttaaaat

SEQ ID NO: 56924 - DNA, 101 bp, rice(Oryza sativa)
  misc_feature (71): n=a or g
ggcacgaaattaacatgcacccgtgatagggagatatagccagaatgtgaatcttaaacagcatttacatngagagtatttaacccctactagtacagatc

SEQ ID NO: 56925 - DNA, 101 bp, rice(Oryza sativa)
  misc_feature (71): n=a or g
ccagaaacgttggcgctaaggtcggaaggttcaatgctaggcccgttagcgttgacccccaacctaggtgnctcttgagtcgatccccttgctaatgtggt

SEQ ID NO: 56926 - DNA, 101 bp, rice(Oryza sativa)
  misc_feature (71): n=a or g
cgaacgtccaacagattagtctgtctcttcacaacacacgcacgctgtaaacaatgatcgagatagttatncgattgaactataaatatgatatatgttgt

SEQ ID NO: 56927 - DNA, 101 bp, rice(Oryza sativa)
  misc_feature (71): n=t or c
atttcaactaaattaatggccgggtctccttcaggttcatctaaccaaaacatcccagcaggtaaattttntccctctactgatgttcttagccgaataac

SEQ ID NO: 56928 - DNA, 101 bp, rice(Oryza sativa)
  misc_feature (71): n=a or g
cggtggcgtttggccgaggactgttgtaactctgatatgttgtaatgtgctgggtcagggaggagcccccntaatcagttccccggggtgtaggttttggc

SEQ ID NO: 56929 - DNA, 101 bp, rice(Oryza sativa)
  misc_feature (71): n=t or c
tgttgagtcaaaaactaagaatctcatatttgttggagcatctacctcagagcatcttttctttgactttngaataaaagaattttagagaaatttcagag

SEQ ID NO: 56930 - DNA, 101 bp, rice(Oryza sativa)
  misc_feature (71): n=a or c
acaagcgagcgataccgactaaaaaaatctctatcgccgggctacaaattagtcggtcgttttattctctnccctccacataggaatttgatgatgtggcg

SEQ ID NO: 56931 - DNA, 101 bp, rice(Oryza sativa)
  misc_feature (71): n=a or g
aaaccttcgatcggaggaaaaacttctacgattgtgacatgagatgagactacgatccagtaacatgctantgagcggaaggagaatgcaagcaatgttta

SEQ ID NO: 56932 - DNA, 101 bp, rice(Oryza sativa)
  misc_feature (71): n=a or g
ggcagtctcaagcttcagattcggtgatggtcgaggggtcacgagttcaccggaaactcctcggcgatganccgggcgatggcgggtagtttaagcatggc

SEQ ID NO: 56933 - DNA, 101 bp, rice(Oryza sativa)
  misc_feature (71): n=t or c
aaaggagattgatgaagtgcctttaccagaactagatacgaaatgaaataaagagctgagatggtttaaanagcttcacaactttattattattttatatt

SEQ ID NO: 56934 - DNA, 101 bp, rice(Oryza sativa)
  misc_feature (71): n=t or g
agcctggctccatgggtctttttttgcatccatcgggtctggctctaagatagttgcacacaaccaaacangcacaaatctaatctgctggctaggtgcga

SEQ ID NO: 56935 - DNA, 101 bp, rice(Oryza sativa)
  misc_feature (71): n=t or c
cagtgggcgccgatcagaccggaggtgtccgagcggtctaaccgggtagcatgacggtctgaccagcagantccaggagggaatcggtttcgggttgtttt

SEQ ID NO: 56936 - DNA, 101 bp, rice(Oryza sativa)
  misc_feature (71): n=t or c
tgttaatggtctaacaggccgacagggaagagcctattaccgattgcgcgctccactgggtttgatagtgngacacatatatataaccttaaatttaatct

SEQ ID NO: 56937 - DNA, 101 bp, rice(Oryza sativa)
  misc_feature (71): n=a or g
tacccttcgatgcgatagagggaggttgtggcattgtcaggcacagcatgggtggaagtggaccagcgccnagggagggcaccgcggcggcaataacaatc

SEQ ID NO: 56938 - DNA, 101 bp, rice(Oryza sativa)
  misc_feature (71): n=t or c
ttcctcaaatactatttgttccatcaattttcctcaattcaattttattatcaacttacttcaaaccatcnttcacttaatgaattcgtcacaaaacgttc

SEQ ID NO: 56939 - DNA, 101 bp, rice(Oryza sativa)
  misc_feature (71): n=t or c
taaaaagttttcttaatttaggaagggagtaggtcaatacatggatatccatttacccaagctagctgaantaatagtcagatgagttcatttttagttga

SEQ ID NO: 56940 - DNA, 101 bp, rice(Oryza sativa)
  misc_feature (71): n=t or c
acaggcacgaggaggaagaaccaacgatttggaaactaagcgatgagatctgatcgggttcctctgtttcntaatagcgccggagaggaatctgcccgttg

SEQ ID NO: 56941 - DNA, 101 bp, rice(Oryza sativa)
  misc_feature (71): n=a or g
aaacatgagaaaaaggaaaaactgtcgcatatccacatgctccgctatctcccctttccgcgcgcgccacntggctgcactacgtggggagagggcgcttt

SEQ ID NO: 56942 - DNA, 101 bp, rice(Oryza sativa)
  misc_feature (71): n=t or c
gtctccctagttctacttggataatgggacttttatatatacaagaccccataagaggaggggggataganagatcaacacacaagacagaatagacacca

SEQ ID NO: 56943 - DNA, 101 bp, rice(Oryza sativa)
  misc_feature (71): n=t or c
tctataagtactaagtatgatatttaggttccatatcgatgtcatgaactatctcgttcctcaaatggtangacgttctatatatctttcctacattggaa

SEQ ID NO: 56944 - DNA, 101 bp, rice(Oryza sativa)
  misc_feature (71): n=a or g
tcacttttcaaaatacatatccgtatttgagtcgtttattaagttaatttgctttcggaagtagagaagantcatataagaaatctcttttcaaaaactca

SEQ ID NO: 56945 - DNA, 101 bp, rice(Oryza sativa)
  misc_feature (71): n=a or g
cacgtcccccaatttgaaaacacaaaattaaaattagcacgcaaacctcacgaatttttgagggggcaaanaaaaagagggaaaagacttgggacccgtct

SEQ ID NO: 56946 - DNA, 101 bp, rice(Oryza sativa)
  misc_feature (71): n=a or g
cgatttcgttctcatcccgtcgagagcagttgcaaataacaggagtacagtgggatcgaacagctagattnttctttaatttgtttacagctctccctctt

SEQ ID NO: 56947 - DNA, 101 bp, rice(Oryza sativa)
  misc_feature (71): n=a or c
ttttctcagcagtgttggataggtcgcaagagaagaggtcttcattcctgatgccttccatgcccataacntggaaaagaacatactggacgacggacaca

SEQ ID NO: 56948 - DNA, 101 bp, rice(Oryza sativa)
  misc_feature (71): n=t or c
ctagaagaggattaatttatctctcttttttttacatgatggattagtggtattatgctccaactaactcnacttccagttgaaacaaaaatggtccatgc

SEQ ID NO: 56949 - DNA, 101 bp, rice(Oryza sativa)
  misc_feature (71): n=t or c
tacttatcaaagattttgagtgagagcgcacctttcattgcaccatccaagacttacaagtaggagcatantctctgtcccaagatgacaaagagtagccg

SEQ ID NO: 56950 - DNA, 101 bp, rice(Oryza sativa)
  misc_feature (71): n=t or c
ctgaacccaacccgcacgattttttaacggttaagatcaagggggacttggtgttcataatctagaaaacnaaaaccaatgtttacttagtaagtggttgt

SEQ ID NO: 56951 - DNA, 101 bp, rice(Oryza sativa)
  misc_feature (71): n=t or c
cgaccacatcgcatatcgcatgcgatgtgttttccgtgcgttgatttggattttgaggccgtgtttagttncccaaatttctaactttccatcatattacg

SEQ ID NO: 56952 - DNA, 101 bp, rice(Oryza sativa)
  misc_feature (71): n=t or c
acacccagctcatctcgtggatgggcatggagcagagcaaatagagagacctgagccagccgcttctactngatacgaagctaaaatgagcgaatgtttgc

SEQ ID NO: 56953 - DNA, 101 bp, rice(Oryza sativa)
  misc_feature (71): n=t or c
tcaaccgatgtgaaaaatctccaatctcttcttgcgaatttctgatgcagtgcaacagctaaatcattgcnccctacatcctccaaattttttaaatcact

SEQ ID NO: 56954 - DNA, 101 bp, rice(Oryza sativa)
  misc_feature (71): n=a or g
tccttttacaagcaatgaatttttctacttttttgtgaagaccgttcattcccttcctctggcttgtcctngtttaagggataatctgtgtttactctgaa

SEQ ID NO: 56955 - DNA, 101 bp, rice(Oryza sativa)
  misc_feature (71): n=t or g
gaagatgtcaccctctctgcaatttctatccgttcgatgagttggccgaacgacctgagccggatatcttnttgggcctgaacagtaacattacgtgcgtg

SEQ ID NO: 56956 - DNA, 101 bp, rice(Oryza sativa)
  misc_feature (71): n=a or c
cgtgcattcggttgccgctttaatcatttggactgtgatagtcataattaattagttagatttgctacggnttatattatcgtatcccgtgtatattggga

SEQ ID NO: 56957 - DNA, 101 bp, rice(Oryza sativa)
  misc_feature (71): n=a or g
tctataaaatgagataggtctttcgtgtcaaagccgatgcggcaattgtgataaggtggaatggtaacatngcaatttttgtttacgtggcaacttatgca

SEQ ID NO: 56958 - DNA, 101 bp, rice(Oryza sativa)
  misc_feature (71): n=t or c
ttaaactactatttggtgtgaaattatattaagtaggtcagaagcatccatacatagtacttcttctgtcncaaaatataaagagtttcggttgaatgggg

SEQ ID NO: 56959 - DNA, 101 bp, rice(Oryza sativa)
  misc_feature (71): n=t or c
tgctagggccacatgtagtacgcgcgcgcccgcacagccatgctaccgtgatgggatggaacagtaatagnggcagacgtgacaaatgagctacagtaaat

SEQ ID NO: 56960 - DNA, 101 bp, rice(Oryza sativa)
  misc_feature (71): n=t or c
gcggcagacattgccagccggaggagagaggagagatggtgctcaacggcgaacagtgggaggtgggctcngatggtggaacgcgacgttcgagcggcggc

SEQ ID NO: 56961 - DNA, 101 bp, rice(Oryza sativa)
  misc_feature (71): n=t or c
tcatttgacaaaaacaagttcatccaaataaaaaaatcccaaatcacaactccacgctaaggcaatcgcancctcagccgccagctcaaggcaaattttgg

SEQ ID NO: 56962 - DNA, 101 bp, rice(Oryza sativa)
  misc_feature (71): n=a or g
ggtgctcaaggttctactactatgccatcaagcctcatcaacaataacgtcaacaccagcatcaaccaagnagtttaaccttcaacaatgctggtgtggac

SEQ ID NO: 56963 - DNA, 101 bp, rice(Oryza sativa)
  misc_feature (71): n=t or c
tgtctcgttcagcatgtacgtgttagcgggattcacgtgtcacgtgagtgcggtgtgtgtgcgcgtctttnatgtaatcgcgcgcgaaaaaataaagaaaa

SEQ ID NO: 56964 - DNA, 101 bp, rice(Oryza sativa)
  misc_feature (71): n=t or c
cagcgaaaaaaaggaaaaatggattgatgggctttttgggccaggagcagcttgcgcgcgtgccaactagnaaccccccaagtcgccagcctccttgcctc

SEQ ID NO: 56965 - DNA, 101 bp, rice(Oryza sativa)
  misc_feature (71): n=a or c
cagcttgcccaaaagacaaaaattacaaaccatctagggtaagcggcctaatgagcaattcacagagactnaaagctccagctaaaattatagtttgtttt

SEQ ID NO: 56966 - DNA, 101 bp, rice(Oryza sativa)
  misc_feature (71): n=a or g
ttaggcccaaccaagttggagtaggctatagacagaacgcaagccgaaccacatgaaccaaaaggaaaaangaagaactaagaaagtagaaatggtactag

SEQ ID NO: 56967 - DNA, 101 bp, rice(Oryza sativa)
  misc_feature (71): n=a or g
ttgttgtgatacaggaggaatttcagagctggaatccattctgacactaacaaataacatcaaggggttcnatttaaattcagaagagatttacagtgtag

SEQ ID NO: 56968 - DNA, 101 bp, rice(Oryza sativa)
  misc_feature (71): n=a or c
actgaccccaattactactgtgtatatcctgtcagtttattggtcaggatataacgtactccagccgttcngtgcacggtcatgccgttagtcatccctga

SEQ ID NO: 56969 - DNA, 101 bp, rice(Oryza sativa)
  misc_feature (71): n=t or c
actacgctcacttcgcaataggtcaaagttttagattgaattatttggtcttctactacaccaaaaaaaantagtgtcataaaaatttcgatatggtggca

SEQ ID NO: 56970 - DNA, 101 bp, rice(Oryza sativa)
  misc_feature (71): n=a or g
cccatgacgtttgctgaggtactccttgcatttggtgatgcattggctcaaactgattgaattgaggagcntactaaggttgaggcgatcctgtctgttga

SEQ ID NO: 56971 - DNA, 101 bp, rice(Oryza sativa)
  misc_feature (71): n=a or g
aaattgtatcaatctgaaccaattagaaggaagaggctatccccatggtacaaacaaaaatattgtcaggnttacggataaggtataccctctacccttgg

SEQ ID NO: 56972 - DNA, 101 bp, rice(Oryza sativa)
  misc_feature (71): n=a or g
gtttaaaaaattcaaatatgacgaacggtcaaacgagtactactggagagatgcacatctctcccggtttntaaccccctttatttctaggtaacgaactg

SEQ ID NO: 56973 - DNA, 101 bp, rice(Oryza sativa)
  misc_feature (71): n=t or c
tacaaacgacttatattaacgacaaatctagacaatcttttatctaaaacctaagctctaaccatttgccnagattagttatattagagcaagtttaatag

SEQ ID NO: 56974 - DNA, 101 bp, rice(Oryza sativa)
  misc_feature (71): n=t or c
tcaaaatcaagcagaacatggagtgtgtagactgtagtagagtatcatttacctatcgaatcatggtgctntccatgactccattaattaacctccttcca

SEQ ID NO: 56975 - DNA, 101 bp, rice(Oryza sativa)
  misc_feature (71): n=a or c
tttttatttttcttctaaatgatttaagtaaaaactgatgagccaatgttttgtttcctaatttttaaganacaacacattgcagctaaaagtagatccaa

SEQ ID NO: 56976 - DNA, 101 bp, rice(Oryza sativa)
  misc_feature (71): n=a or g
tcactgatgttaagaggaatcacaagttcacaaccatactccctccatactagtaaaaaatgacgtttagnacagcatttagcataccaagaagtgattaa

SEQ ID NO: 56977 - DNA, 101 bp, rice(Oryza sativa)
  misc_feature (71): n=a or g
ggtcaacttgtaacatgatcaccgaaaaatataaatgtagtcatgatatctgggaggccacaggaataagntcaagctagttggggatcggataagcacca

SEQ ID NO: 56978 - DNA, 101 bp, rice(Oryza sativa)
  misc_feature (71): n=a or g
ttgaagttttatatagatgtatacatgcttagaatcgtatgcacaatcattcataagtgcgcacatcttcngttttcggcgcatctatctgctcattgtga

SEQ ID NO: 56979 - DNA, 101 bp, rice(Oryza sativa)
  misc_feature (71): n=a or g
cgccacgtcagctaaaaccacctttaaaaccaccgagggatcttatttgcatcggttttaacagtttgggnaccgattgtatctggttttggggttcaaag

SEQ ID NO: 56980 - DNA, 101 bp, rice(Oryza sativa)
  misc_feature (71): n=t or c
gcgacgtggggaggtggagagagagagatgggggggattcaaaatgaaaccagctccttgcgggcgcacgngcgggcgggaaagcagggcggagtgggtgc

SEQ ID NO: 56981 - DNA, 101 bp, rice(Oryza sativa)
  misc_feature (71): n=t or c
acaaaaacaaaataaaaggaaagaaaaaactgaaagaaacgaaaaattaaaaaaaaacagaaaaaccgtgngtgggccggaataggattttttttcccgtt

SEQ ID NO: 56982 - DNA, 101 bp, rice(Oryza sativa)
  misc_feature (71): n=t or c
cgctgccttgtgggtctgggtgcttgggagggtgctcgtattctgtcgcgaggacttccacttgagctttncttttcccactcttgcgacttttcttcttg

SEQ ID NO: 56983 - DNA, 101 bp, rice(Oryza sativa)
  misc_feature (71): n=a or g
atggcaagaccttactctataatccttacaggaggcagagtgcaaggttgcagcagagcaaggaggaagtncaactacaagtgaatcctataatgggcatt

SEQ ID NO: 56984 - DNA, 101 bp, rice(Oryza sativa)
  misc_feature (71): n=t or c
tcactcggtgcgtaagctaactagctttttcccgatggaaaaatggaagctgctactagtatactccctcngtcctaaaatataataatttttagccttca

SEQ ID NO: 56985 - DNA, 101 bp, rice(Oryza sativa)
  misc_feature (71): n=t or c
gcatggctgcatggcacaaacgacaaagcactaaaagccatccaggataaatgaataaaacaaacagcacntggctacttgccaatataataccactagat

SEQ ID NO: 56986 - DNA, 101 bp, rice(Oryza sativa)
  misc_feature (71): n=t or c
gttgaagatcactaaccaaaagcataggcgatactcggattgtactcgttgcgcaccatgttgtcgccgtnggcgtaccacgccacctcgtcccccttgtt

SEQ ID NO: 56987 - DNA, 101 bp, rice(Oryza sativa)
  misc_feature (71): n=a or g
ctatgactgctccctgtggtgataactggcagcgtgggctacaatgacgacgacgttggtggcaagctgcntgacgacggatccgtccctggcatcaggat

SEQ ID NO: 56988 - DNA, 101 bp, rice(Oryza sativa)
  misc_feature (71): n=a or g
ccaaactgcagtcatggctcgcgtaagcattcggggtagaacacctttagaaagggatcgccaatacactngttatggttgggatagtaagtctgctatgc

SEQ ID NO: 56989 - DNA, 101 bp, rice(Oryza sativa)
  misc_feature (71): n=t or c
atgtcagaaactcaagacataaagagtattcagcatagacaatagaaattggttaggggtaaaacagcacntagtaatagcctactaaaatactccgaaat

SEQ ID NO: 56990 - DNA, 101 bp, rice(Oryza sativa)
  misc_feature (71): n=t or c
gtgagctcgagctcggttcgacaaagctcacaagcttgcagctaggcttgggttcggctcattaagagctngagccgagctcaaatcaattctgagacgag

SEQ ID NO: 56991 - DNA, 101 bp, rice(Oryza sativa)
  misc_feature (71): n=a or g
aattaaatcatattacatagaaagtatagtgtttattacaagtatcccccgcgacaaatacatccatttantccacagcatgttgcctctcccactctctt

SEQ ID NO: 56992 - DNA, 101 bp, rice(Oryza sativa)
  misc_feature (71): n=a or g
acataatgtccccttgaatcggacggagggtgaagccgtggagcgcagattggtcggagtcggagagcagntgttggtcgagagacatcgaggttcacaat

SEQ ID NO: 56993 - DNA, 101 bp, rice(Oryza sativa)
  misc_feature (71): n=t or c
accctgtaggaaagttttcgaattaacacaataaattacagacatgcaaaggagtaacacatcatcttagngtgcagaaaagacatgtgttggtctgtgag

SEQ ID NO: 56994 - DNA, 101 bp, rice(Oryza sativa)
  misc_feature (71): n=a or g
aaatatggggctttgtggactgggatacccattgtgggtttgagtgtctctattagttgcttcagattttnaggagcccatctaggagtgtcctccattac

SEQ ID NO: 56995 - DNA, 101 bp, rice(Oryza sativa)
  misc_feature (71): n=a or g
cttgctctctcttgactttctcgctctttctctctcagaggagtcgcttggcagtggcgcttgcccctcgntggagtgtggcagaggctcgctctcgtgcg

SEQ ID NO: 56996 - DNA, 101 bp, rice(Oryza sativa)
  misc_feature (71): n=a or g
cttaaacaaggtggtcaaagcgttattccaacttcccaacactgagcagtccagcgtgtgcaaatactgtngcttattaggtgcgttggcgaaatgatgca

SEQ ID NO: 56997 - DNA, 101 bp, rice(Oryza sativa)
  misc_feature (71): n=a or g
taaaccgattacgatagggacaatcaacagtatgcactcatatgcaatgggtatagaactggaagcaacanctgcaactttgtaattaccatatgaccttc

SEQ ID NO: 56998 - DNA, 101 bp, rice(Oryza sativa)
  misc_feature (71): n=t or c
cgcctcccctcattgcaccgcacccacgcaccgtatccagatcgaaaaaaaaatcgccatctcgccgcctngccggttcgacgccagtcgccgcctcgacg

SEQ ID NO: 56999 - DNA, 101 bp, rice(Oryza sativa)
  misc_feature (71): n=t or c
ttttgtgcatctggataaaatcatcaagatcaggtatttcatcgtgggacactgacattttctcccccctntgggaaccgttcttcccaatcaacttctcc

SEQ ID NO: 57000 - DNA, 101 bp, rice(Oryza sativa)
  misc_feature (71): n=a or g
catgtgcaaaagtccatattgagttatatgcaaacacaaaagtttaatcagaaggaccagcaattcacttntaattaacagtcctttaggttaaaaaaaag

SEQ ID NO: 57001 - DNA, 101 bp, rice(Oryza sativa)
  misc_feature (71): n=a or g
gggacagtaatggaaaactgttttaaacactcaggtgcacgtctacccatttgttacatgttaattaaatnattataaaaaaaattaaaaaaattgataag

SEQ ID NO: 57002 - DNA, 101 bp, rice(Oryza sativa)
  misc_feature (71): n=a or g
gatttgggctctcgatcgactctggattttcggtttttggggtttctgtgggctgttcgttcggtgatggncggcccagtttcatcaagccggccggccca

SEQ ID NO: 57003 - DNA, 101 bp, rice(Oryza sativa)
  misc_feature (71): n=a or g
tatatacataatgcgactatattaagttattaggggttaagatgtacgagcaatacggcaatgaacaatcnatttttaaccaacttgtgatgagctgttaa

SEQ ID NO: 57004 - DNA, 101 bp, rice(Oryza sativa)
  misc_feature (71): n=a or g
agcggggtggtgtcgggcggagcagccatgcatgaagcaggcaggaggaacgacgatagccggagaagacngcgggcggagcggggtggcggcggtggggt

SEQ ID NO: 57005 - DNA, 101 bp, rice(Oryza sativa)
  misc_feature (71): n=a or c
gtattactatatcaaccctggatcattaacattgatacagatattacaaccggatgttcattacacatgtncaaattacaagaggtataatattacataga

SEQ ID NO: 57006 - DNA, 101 bp, rice(Oryza sativa)
  misc_feature (71): n=t or c
taattatttaaagaatatctatatgcgtagcctacatacatcccttatgaggatttgttttagaaaatagnatatttaaaataaaggaatttaatatgaaa

SEQ ID NO: 57007 - DNA, 101 bp, rice(Oryza sativa)
  misc_feature (71): n=a or g
ctatggaaaatagaattagggagaagtaaaactctgtttctccttccttattcgaaataccttctgtaatnaagcatgattttgtataagacttggtatat

SEQ ID NO: 57008 - DNA, 101 bp, rice(Oryza sativa)
  misc_feature (71): n=a or c
gagcaaccagagagcgccgcgcgcgcatgcacgagctaggcggagtaccgtacgtactaacacgcccacanaccggacaccgctgccgtgccgtgccggcc

SEQ ID NO: 57009 - DNA, 101 bp, rice(Oryza sativa)
  misc_feature (71): n=a or c
caaaattcttttgaactttgataatggtgccatctatggcggctctaacaaattttaccttaatatacaanttgtataaagaataacaaaaagagaaatgt

SEQ ID NO: 57010 - DNA, 101 bp, rice(Oryza sativa)
  misc_feature (71): n=t or g
ggccatggacgacgaccgtcggcggcgcctcttcctggattcgtcaggtaacgcccggattcagttccctncgattttggtggggttgccccattcgattc

SEQ ID NO: 57011 - DNA, 101 bp, rice(Oryza sativa)
  misc_feature (71): n=a or g
tggcatccgaagacagtgaacgcaggctatagtgctcaacaaaatggagtgcagaaaggaaaaatcggacnatcaatgatatggccaattctatgcttcaa

SEQ ID NO: 57012 - DNA, 101 bp, rice(Oryza sativa)
  misc_feature (71): n=t or c
tcggtcgccgcccgtcaaaggtgacttacctcaacagtgaccattgttctctgaccaggcccagaccactnatatgtgagggtttggggccgtcagaggtg

SEQ ID NO: 57013 - DNA, 101 bp, rice(Oryza sativa)
  misc_feature (71): n=t or c
caagcatgaaattctcctacatatgtgtaggatgaatgagcctttaagatcatttgtttctgattggttanaaaatttgtaaagattttgcctgtaatatg

SEQ ID NO: 57014 - DNA, 101 bp, rice(Oryza sativa)
  misc_feature (71): n=a or c
aagctagctagtcataggagcatgagttcacccaccagggttaatcctagtcttcgtaaatatatacttcntccgtttcatattataagactttatagtat

SEQ ID NO: 57015 - DNA, 101 bp, rice(Oryza sativa)
  misc_feature (71): n=t or c
cctcggttagcaaatacaaaagtaacaagatgaatggggtggataagctttgtagtgttgattgggtctgnccatcattccacaccaactatttatggcac

SEQ ID NO: 57016 - DNA, 101 bp, rice(Oryza sativa)
  misc_feature (71): n=a or c
tattatttgacatagtttatatggtcatatatgtgttagaaattatctgatctaattgataaatgctttanaattttcaaatgaattgaagtagacacaaa

SEQ ID NO: 57017 - DNA, 101 bp, rice(Oryza sativa)
  misc_feature (71): n=t or c
ccctgcctgctgcagcactgcaactgcactgtagcagcagctacagtggctatagcagccagccaacaagngctgtgcagcatagcccagaccgttgtagc

SEQ ID NO: 57018 - DNA, 101 bp, rice(Oryza sativa)
  misc_feature (71): n=a or g
aaatgaataaaaacctaggagatgctcactagtatctcttgtctgactatttagaaataattctatttttnattggatttatgtcgtgccaatcataattc

SEQ ID NO: 57019 - DNA, 101 bp, rice(Oryza sativa)
  misc_feature (71): n=a or g
gtggcgccctagggctaatcttaggacgtccttaatcatatttgttgagtagtcgccatagtttagagtcnagtttcggttagattatttctaccattgca

SEQ ID NO: 57020 - DNA, 101 bp, rice(Oryza sativa)
  misc_feature (71): n=a or g
agcacctgcgtcagcatcgggctcttcagcgccttgacgtgatggattggtggggaggaggctgagaaatngtggagagagatggggaaaaagaggagggg

SEQ ID NO: 57021 - DNA, 101 bp, rice(Oryza sativa)
  misc_feature (71): n=a or g
aaattgtactctgaaagatatgtttcttaaatacatcgtgattaccacagaacaattgaataattgtgaantcaaaataaaccttggattcaccattgaga

SEQ ID NO: 57022 - DNA, 101 bp, rice(Oryza sativa)
  misc_feature (71): n=t or g
tttcacctagttaataaagttttgaataatcttaaatccgttgatgagggcatagtaggaggagtggtggngtaggatttttgtaggatgccggttgatga

SEQ ID NO: 57023 - DNA, 101 bp, rice(Oryza sativa)
  misc_feature (71): n=t or c
tcacagctgtgacggcctctcaaatgcctaggttttgggggccgtcacgacttagtcatctcaatcggggnaaaataaacactgtcaaatatatactcgta

SEQ ID NO: 57024 - DNA, 101 bp, rice(Oryza sativa)
  misc_feature (71): n=t or c
gttgtaaataaagactcaatttgtgatgcctgtcaaaaaggcaagagtcatcagcttccatacctaaaatnctcaagtgtgtcgagtcgtcctttagaact

SEQ ID NO: 57025 - DNA, 101 bp, rice(Oryza sativa)
  misc_feature (71): n=a or g
agatagaaaagaacataaaggtaaaaaagatgaatggtagaatgaaattgttcagggtttcttctaatctnccgtcaccagtatatatactggttactcta

SEQ ID NO: 57026 - DNA, 101 bp, rice(Oryza sativa)
  misc_feature (71): n=t or c
taaagtggtgtcgaccagatcgatttaagcaggtgctccaacacatcgatcagggggtgtttagatggggntaaaactttttagcccatgtcatatcggat

SEQ ID NO: 57027 - DNA, 101 bp, rice(Oryza sativa)
  misc_feature (71): n=a or g
atagaaatgaactcaagcctaaaaatagataatacaagttgactaaaaaagaaaataaactattgtctacntgtaatatgcttaagacatactctcaccgt

SEQ ID NO: 57028 - DNA, 101 bp, rice(Oryza sativa)
  misc_feature (71): n=t or c
ccacctttgcatgcatgttacatgcacatgtaggttttttcttaagtagaaaaaatagagtaaattacgtncacagtacataaacttggtaggtaggtgcg

SEQ ID NO: 57029 - DNA, 101 bp, rice(Oryza sativa)
  misc_feature (71): n=a or c
acagtttttatatagaaaattatctggaaaaaaacatactgttaaaccgattgaaaaaaattgctaacaanataaaggtaaaatatgtatcttaacaaaat

SEQ ID NO: 57030 - DNA, 101 bp, rice(Oryza sativa)
  misc_feature (71): n=t or c
atatcttggctaatctagtttggtagctcgatttactcgtattggttgggatctgctttagggttttcgcnggtatcaactaaattgcttttccagattag

SEQ ID NO: 57031 - DNA, 101 bp, rice(Oryza sativa)
  misc_feature (71): n=a or g
ccgtagcacacgcgcggcggcgtcacgggagggtgtacgtgtcacgtgtcggtgtgctgcagtggcagggngtggtaaatagcctcctcggttgatctaat

SEQ ID NO: 57032 - DNA, 101 bp, rice(Oryza sativa)
  misc_feature (71): n=a or g
gcacataaaaaaatgattagcatatcttaaaactgacgaagtaaccatgattactatgggcaccgccgaangatttgactagcacattatgagattcataa

SEQ ID NO: 57033 - DNA, 101 bp, rice(Oryza sativa)
  misc_feature (71): n=a or g
gggcgcctccaaaatgcaaattcttctcatggctcgtcgtccaaaatagaatatggacatcggataggctngagcaaagaggttggtagaataaaaaagtt

SEQ ID NO: 57034 - DNA, 101 bp, rice(Oryza sativa)
  misc_feature (71): n=t or c
cacgtatatgagtgacaaaatcatatatactggcttttaattataaaccggcacatatatatacaatgctnatatatgacggttcaaaatgaaaaccggca

SEQ ID NO: 57035 - DNA, 101 bp, rice(Oryza sativa)
  misc_feature (71): n=a or g
tatagttgcacaaatgatcacagtaaatcacccaactgatgagatgattcaggatggaatgaaccctcacngcttcatggagtctactttccagatcaaat

SEQ ID NO: 57036 - DNA, 101 bp, rice(Oryza sativa)
  misc_feature (71): n=a or g
tcgcaccccgctcgacctcgatctccagtagcactcgcacgttgtacttgggctcaagctcctctccgccntcccggctcgacctcgatctccacggcttc

SEQ ID NO: 57037 - DNA, 101 bp, rice(Oryza sativa)
  misc_feature (71): n=a or g
tgcaggtctctcattctctttgtaagaccagtaagttccagctgattctagtcagtctcattttccttctnaattagtacgtatttaataggaaaaatttg

SEQ ID NO: 57038 - DNA, 101 bp, rice(Oryza sativa)
  misc_feature (71): n=a or c
agatgggacattcttgtggtgatactgctaccattatctgtatggctgtaggagtatatcataggctggtnagctaccgcgtcaaacggaagcaagcgagc

SEQ ID NO: 57039 - DNA, 101 bp, rice(Oryza sativa)
  misc_feature (71): n=a or g
tttgataggtgtgcggcaggacatatcgaacaggcaatgttcgataggagcacggctacagtgctctacantgttttttttctcttttataaaattatttt

SEQ ID NO: 57040 - DNA, 101 bp, rice(Oryza sativa)
  misc_feature (71): n=a or g
agccaaggaggcgggaagggagatagcaagcggcggggaagggggaagacaagcggcggagtggagcaggngcgacggtgaggccagatccatggcgggcg

SEQ ID NO: 57041 - DNA, 101 bp, rice(Oryza sativa)
  misc_feature (71): n=t or g
caagcaaagtggatcctagttggtagaaaaaagaaggaatttaattggggcatcaagtttttttttgagtncaagaaatagattttgatgagtatatgttt

SEQ ID NO: 57042 - DNA, 101 bp, rice(Oryza sativa)
  misc_feature (71): n=a or g
caattcaaaattttacccattttaaccctcaactacgcactcacctataagcaaatatcatttaacagggncattctagtattgtcttgctatccttaaac

SEQ ID NO: 57043 - DNA, 101 bp, rice(Oryza sativa)
  misc_feature (71): n=a or g
agtcgacttctgggcgtcatccatctcctatcggcaaccttcataatattgttgccgatacgttccagccnatgcaatcttccaactttagatcccaaaat

SEQ ID NO: 57044 - DNA, 101 bp, rice(Oryza sativa)
  misc_feature (71): n=a or g
taataataatttatttttaatataaataaattatcgaacgtgtactgaaaattcaacggcgttatctatcnaaaattgtacctttaataatcgtacatatt

SEQ ID NO: 57045 - DNA, 101 bp, rice(Oryza sativa)
  misc_feature (71): n=t or c
cagtgaggtcctcatccaatgagtttactaatgagtttttattgtttcgtgtgtaatgaaaatcttcattnaaaccaagggaaataatacaaccttattaa

SEQ ID NO: 57046 - DNA, 101 bp, rice(Oryza sativa)
  misc_feature (71): n=a or g
cggattagggagagacagtgcgtgtgtgtgcaagtgtactgtcagagttggattagctatggctaattaanggcctgtttgatataactccaactcctaaa

SEQ ID NO: 57047 - DNA, 101 bp, rice(Oryza sativa)
  misc_feature (71): n=a or c
attcttcaaaggaaaataacaaggcatgtaacggtgtttaccatatcttcttgagcgccacatcataaacnatgcgatttatatatatagtgtgagagtaa

SEQ ID NO: 57048 - DNA, 101 bp, rice(Oryza sativa)
  misc_feature (71): n=a or g
attcaagtattttgaaacaaattagatcaactattgaaaatcgttgtgatgaaacatgatactagttaacnaaccatctttaggacgttcgttccgcctat

SEQ ID NO: 57049 - DNA, 101 bp, rice(Oryza sativa)
  misc_feature (71): n=t or c
gctatttaatagccctccggatccaaacagggcccatgtatgaacggacacttaccactgatcttaatggntgtacgacaatgtaagaaatatccatacaa

SEQ ID NO: 57050 - DNA, 101 bp, rice(Oryza sativa)
  misc_feature (71): n=a or g
gttcttccgaaccgtcagtcctgcatctactcgaggactacgactcctcgtcaacaagtacgccacgtgangtattggctatcgacgggacaggcacatcg

SEQ ID NO: 57051 - DNA, 101 bp, rice(Oryza sativa)
  misc_feature (71): n=t or g
tgacgcatttgttcgatgaaattgagctggcctttttttatttttggttcgtaggaacacttttttttttnatgattggggattaatcaagaggacctata

SEQ ID NO: 57052 - DNA, 101 bp, rice(Oryza sativa)
  misc_feature (71): n=t or c
aaggcaataagacgtactcattttttttttgtgtgtgattcatgaacagaaaatataagaggcgacaaagnatctatgtactaacgagttttaaagttgtt

SEQ ID NO: 57053 - DNA, 101 bp, rice(Oryza sativa)
  misc_feature (71): n=a or g
aagatcatacaaagtcaattatatcatcgcacgactttagaagcccgtacgtgcacctccacggcccaccntacaatgaacgtgcatgcgcgccgcacata

SEQ ID NO: 57054 - DNA, 101 bp, rice(Oryza sativa)
  misc_feature (71): n=t or c
acatgtacgtgtagtttaaagttgccatcttaattgatcaagttatgctaaaattgtttttatactaccanaggtaccttggcaaaccaccaaatgttcaa

SEQ ID NO: 57055 - DNA, 101 bp, rice(Oryza sativa)
  misc_feature (71): n=a or g
ggagatcgaaaccgatgcaacccaacttgaagcaagaactcgtcaaaagtaatggaatagaaaaggtggcnatgcgccgaaagtgttattgaactgttgtt

SEQ ID NO: 57056 - DNA, 101 bp, rice(Oryza sativa)
  misc_feature (71): n=a or g
gaccgacgacggcccccacgcgctcctaaacctctccatcacgccggcgaacgcgtcgcagttgctgtctncggggctagctggcgtcgtcgctcgtcacc

SEQ ID NO: 57057 - DNA, 101 bp, rice(Oryza sativa)
  misc_feature (71): n=t or g
cttcgcaggcgcaccttatatggtccgcctgcgaaaatgaggagcaatattaatagaccaggctagagcanattttttctaagtcccattctctccctcac

SEQ ID NO: 57058 - DNA, 101 bp, rice(Oryza sativa)
  misc_feature (71): n=a or g
aagaagaattgtgccacgtggcaacaccggtttcacgggatggctcgatcctgctaattgcgcgcgtgcangctatgtgatttctcgcgttgctgccgtac

SEQ ID NO: 57059 - DNA, 101 bp, rice(Oryza sativa)
  misc_feature (71): n=t or c
tgtatataccttggatgcatatacaattacaaaatcacctagaatgcacctgccagaggagagctgcctantactgtcttcaactagttcttgcacctctc

SEQ ID NO: 57060 - DNA, 101 bp, rice(Oryza sativa)
  misc_feature (71): n=t or g
gtaagggactactactgctacaaattccagatgcgccgtgggattttcaatcctatacttcacggcggacncctattccagcagttcgctgttgacatgta

SEQ ID NO: 57061 - DNA, 101 bp, rice(Oryza sativa)
  misc_feature (71): n=t or c
atatatgaattaggcatatgactacttaaccctgatagccgccgtcacggaagtaccagctggaatgggangttacgaattcaggtggtttcgtgatagca

SEQ ID NO: 57062 - DNA, 101 bp, rice(Oryza sativa)
  misc_feature (71): n=a or g
ccgcttcgacggcgaggacgtgttcatccacgtggcgtgcgtgaaggagctcgccgtgcggaggtgggagncgagctaccgccgccgcagcggcgccggcc

SEQ ID NO: 57063 - DNA, 101 bp, rice(Oryza sativa)
  misc_feature (71): n=a or g
ggccctagcttagctagggcattggaaaaacactgctccttgcatcataaaatagttcaaactttatcccnaataaagcaacccagtattataaaatgtga

SEQ ID NO: 57064 - DNA, 101 bp, rice(Oryza sativa)
  misc_feature (71): n=t or g
ccaggttaccaaatccaacgaggtaacgagtaaaaatcgagctcacctatgggggacgcaccgcacgcacncaggtagtagtggtaggcccgtagctttca

SEQ ID NO: 57065 - DNA, 101 bp, rice(Oryza sativa)
  misc_feature (71): n=a or g
aaactgatatctatctcagtatgagcctgacaaattcaaatctagaaaatgtattatttttcttatttccnagtggttaaataaacaactcttctaatatg

SEQ ID NO: 57066 - DNA, 101 bp, rice(Oryza sativa)
  misc_feature (71): n=t or c
taagagaaaagttggaatcaagcaataataataattactaatcttcacatctcaccaatgtatctgtcgantgtaactttgatcttttaaatatggattcc

SEQ ID NO: 57067 - DNA, 101 bp, rice(Oryza sativa)
  misc_feature (71): n=t or g
tcacaagcgtccttttttttgtgtggcgtgcgtgtgtatatatctacgtcattataatgcctcgcaagtgngtggtatttctttatataatatagtgcatt

SEQ ID NO: 57068 - DNA, 101 bp, rice(Oryza sativa)
  misc_feature (71): n=t or c
aaaggcccgcgggggaaattgccacgggtattatttctggtccatttggaagcccacgaggcagggatttnccggcccaatccgcggggaaaccccaggga

SEQ ID NO: 57069 - DNA, 101 bp, rice(Oryza sativa)
  misc_feature (71): n=t or g
gatagttcatgccttctagttggtttttaaggactataggaaaacacgcataatcttatacagagtggcancagttgataatagtgaatcatgttgaaatt

SEQ ID NO: 57070 - DNA, 101 bp, rice(Oryza sativa)
  misc_feature (71): n=a or g
aatctttctcaaaacctgattgagccacgtcatctgcttaatatgagctgttggatgcagcagaaattcantccctgacgtacgatctagtttaaaggaaa

SEQ ID NO: 57071 - DNA, 101 bp, rice(Oryza sativa)
  misc_feature (71): n=a or g
catctttatatgctattatccgaaggaaatctattatccgaaggaaatcgtcttctattgccactgtcatnggatctgttccgcttaatgtttcttttaga

SEQ ID NO: 57072 - DNA, 101 bp, rice(Oryza sativa)
  misc_feature (71): n=t or c
gagatatatgatgcatgtttgtttctctctcgcagtagagcccaacaaattgaaagcaaatccaatggctntaatttgtaggggagtttgtggttaggcaa

SEQ ID NO: 57073 - DNA, 101 bp, rice(Oryza sativa)
  misc_feature (71): n=t or c
catgtaattccagcatatatgttaaaagaaaggagcattttattaattgctgcgtattatgtaggtgactnggaaatatgatctttttaaacaaaaaaatg

SEQ ID NO: 57074 - DNA, 101 bp, rice(Oryza sativa)
  misc_feature (71): n=a or c
ggtattactagagcaaacgactgtttagttagttcgttattgatgatcagctgatcaactaacagatgtantaggtcaataataaaatctatatgtattca

SEQ ID NO: 57075 - DNA, 101 bp, rice(Oryza sativa)
  misc_feature (71): n=a or g
ttgctcgcacttctgaatgttattggtacttatgggaattttgatggcaattcttcttatgtttccgcttncaccattaaatatgattttactatgctatc

SEQ ID NO: 57076 - DNA, 101 bp, rice(Oryza sativa)
  misc_feature (71): n=a or g
tgaacaaaacaagataatgctatagtacaaattgaacaaaaaaacctgcatgctgcgtttctttgcaagcnttgtccttgttgctgtttgactttgagttt

SEQ ID NO: 57077 - DNA, 101 bp, rice(Oryza sativa)
  misc_feature (71): n=a or g
aggtagacacaaatgtagtggtgtaggcttcgggtgggagatgtattggttagtggttagtgataaagggngatataatgatgcatgaggtaattaagagg

SEQ ID NO: 57078 - DNA, 101 bp, rice(Oryza sativa)
  misc_feature (71): n=a or g
ccggccatagccgccgaaggagtatctccgtacgccgcgatcagcacatgcagcggtcgttgaggttgccngtgtggaaacagatggcgccgaccatggtg

SEQ ID NO: 57079 - DNA, 101 bp, rice(Oryza sativa)
  misc_feature (71): n=t or g
cggccctagccgtccctacctattctttgctcgcctcagcacctccacactagcgctcctctccgcccgcnctgctcttcctccccttccgtcggtgcccc

SEQ ID NO: 57080 - DNA, 101 bp, rice(Oryza sativa)
  misc_feature (71): n=t or c
cgtcgcgaagatttcctgttttgctcttgcagcgtttgtggttgtaggcgcgtggtgtggttgtttttttntttctgggctatagtcttccaggactataa

SEQ ID NO: 57081 - DNA, 101 bp, rice(Oryza sativa)
  misc_feature (71): n=t or c
atcaaacttcttctaagtttgaccaagtttatagaaacaatataatacttcatctcttccattttaagtgnggccatgatttcccgtgctcaattttgatc

SEQ ID NO: 57082 - DNA, 101 bp, rice(Oryza sativa)
  misc_feature (71): n=a or c
aaacatgaatacaaactttgtatacacgtacatcttaaaaaaaaaaaacaaaatagaagagaaaccccccnaaaaaagagaaaaactcgcttctccgttct

SEQ ID NO: 57083 - DNA, 101 bp, rice(Oryza sativa)
  misc_feature (71): n=t or c
ctagcagcatcaagaacctgtcccggtccttgaaccggctccctattagggcgcgcatcgtcgagtcagcngagtaggccgaaatgagctcgctaaggttc

SEQ ID NO: 57084 - DNA, 101 bp, rice(Oryza sativa)
  misc_feature (71): n=a or c
cttatttatattgggatcggtataaatcaacctagaaaatagaggacactttttttccatttttatctctntggaatctactcccatcctatgttttaaaa

SEQ ID NO: 57085 - DNA, 101 bp, rice(Oryza sativa)
  misc_feature (71): n=a or t
atattggattattcgttcattaattcgatggttttctagcccagacctcgatcttacctacggtcgtaaangaaagtattttttcaaggagcgtgtatatt

SEQ ID NO: 57086 - DNA, 101 bp, rice(Oryza sativa)
  misc_feature (71): n=c or g
ggagcgcgaggagaagtcgctggaagggtaggtgagtaaattaatttcgttcctctcccgtgaccacgcgncagggtaacgccccactgtgggctcggttt

SEQ ID NO: 57087 - DNA, 101 bp, rice(Oryza sativa)
  misc_feature (71): n=t or c
aacacagtccgtaggcctcagtcagagcattagagttctcactggatgtgagcagactcctctaattctcngaaaggagaactcacctttggaaggtgaca

SEQ ID NO: 57088 - DNA, 101 bp, rice(Oryza sativa)
  misc_feature (71): n=t or c
tgtccgtttctaagtttgtgttctttgcaaagtactcctccttctatttttctttttttctttcgattaangtgggattttctaggccgtgagagcgaacg

SEQ ID NO: 57089 - DNA, 101 bp, rice(Oryza sativa)
  misc_feature (71): n=a or g
tcggcacatcgccaccttttaccttttcttctttttcgacgagtttattcctatcatggcgccttgcatcngcggggctagggcttcgacactctgatctt

SEQ ID NO: 57090 - DNA, 101 bp, rice(Oryza sativa)
  misc_feature (71): n=t or c
cagtggatgaagggtcgtctgttcctgctgtagttgatgctccaattgatgaagacacaatttacattgtnatttaggtaagatttaaacttatttgttat

SEQ ID NO: 57091 - DNA, 101 bp, rice(Oryza sativa)
  misc_feature (71): n=t or c
gaaccataagtccataattggtttctccatgattgggaaacggtccgcccgcgcgccacgccacgacacanatccacgcacgcaggcaggcaggcaggcag

SEQ ID NO: 57092 - DNA, 101 bp, rice(Oryza sativa)
  misc_feature (71): n=c or g
ttcaaatggaaaaggcttgagatgcccattatcgagcgatataacaacggttgcacaattcgcctctgctntcgataaaacaagtcagaatcaattggcaa

SEQ ID NO: 57093 - DNA, 101 bp, rice(Oryza sativa)
  misc_feature (71): n=a or t
ttacacttgtacacgcctacatctgatgcttcatcatgctcaattccttctgctgatctatctgctgggcngatggcatcttctttaatttcagatattac

SEQ ID NO: 57094 - DNA, 101 bp, rice(Oryza sativa)
  misc_feature (71): n=c or g
gaattgctgttcaaagatgcatgattcgaagttcatgtggtgtgatcgatctgttcaggttcttgaacaangcgtgcatgatcagcaacacgaaggaggac

SEQ ID NO: 57095 - DNA, 101 bp, rice(Oryza sativa)
  misc_feature (71): n=a or t
cactttctctctctgtcactagctactgtgtagtctggtgtgtgtgtgattgattggtacagtgtgtgtgngagagagaggggactagtctgtgagtaacg

SEQ ID NO: 57096 - DNA, 101 bp, rice(Oryza sativa)
  misc_feature (71): n=c or g
attggagactttggaatcttggtatcaatttgaactacacagggcacatgatctgatatattccgggtcanggagtggacagtagtgtttgggaaaactaa

SEQ ID NO: 57097 - DNA, 101 bp, rice(Oryza sativa)
  misc_feature (71): n=a or t
gtataagaacctattttaggggctttttggttggtgtctaactttgtcacaacaaccttgagcaaaaaaanatatatatcattgcacaaaagtttgacata

SEQ ID NO: 57098 - DNA, 101 bp, rice(Oryza sativa)
  misc_feature (71): n=c or g
tcgcggtttttaattccactatcacatatgatccctccgtatctacatacggctcgatttgaaatagatgntcgatttgaaatagatggttgatgtgtata

SEQ ID NO: 57099 - DNA, 101 bp, rice(Oryza sativa)
  misc_feature (71): n=c or g
gcacctataagaagcatatatgtgccatttgtacaccgggcaggacacgggacaagggttataggtgtttntttgtaagtaaaaccagcacctatatgtta

SEQ ID NO: 57100 - DNA, 101 bp, rice(Oryza sativa)
  misc_feature (71): n=a or t
gtccagtgaaacttttatccgtttatggtgagtatttgcgccctccaagcatctccaccgtttttttttanaaaaaaagatgcatctccaccctgcgtggc

SEQ ID NO: 57101 - DNA, 101 bp, rice(Oryza sativa)
  misc_feature (71): n=a or t
gagatggaaaaagctagagaagaggcagatcaagcccaggcagaggtaaatgttgttcaattgagaatagnagcaacattgagggagatacttgcagttaa

SEQ ID NO: 57102 - DNA, 101 bp, rice(Oryza sativa)
  misc_feature (71): n=c or g
atcgaagcagtaggaaagcaatggttgggattaagcattcaatgaatttacactccgccctttgaccacanagggcaaatggaaacaagttaacatctatc

SEQ ID NO: 57103 - DNA, 101 bp, rice(Oryza sativa)
  misc_feature (71): n=a or t
ttgattgttctgtttgggataactccctgtttttggagctttctgagactgcggattgcttgtgtaatganttctctcttcttcttaagatgaaacaggca

SEQ ID NO: 57104 - DNA, 101 bp, rice(Oryza sativa)
  misc_feature (71): n=c or g
tattaggttcaacaagatcacttccaattcacggtttaacaaggagaacactcattctcttcatcacacgncttctgtcggcggcctcgactactgtcccg

SEQ ID NO: 57105 - DNA, 101 bp, rice(Oryza sativa)
  misc_feature (71): n=a or t
gttcttctccttcatctcgaacacccgagcctgcattgcattgcaccatggaaacacatcatcatcatcancatcatcatcaacaatggcgtcctacgtct

SEQ ID NO: 57106 - DNA, 101 bp, rice(Oryza sativa)
  misc_feature (71): n=a or t
cagcctatctaccagaacgagtcggagtcggactcaccaatcccccaaataaatccaccgaccaccgccangcgccaattctccaaatccgccgccaacca

SEQ ID NO: 57107 - DNA, 101 bp, rice(Oryza sativa)
  misc_feature (71): n=a or t
ggacaaggaaacgttttattttttaaagtagtagagttaatatatagtctatcagcaaccacaaattaagnggccgtttttttttcgagctgcagtgccta

SEQ ID NO: 57108 - DNA, 101 bp, rice(Oryza sativa)
  misc_feature (71): n=a or t
tttctgacatatatgtatttactatattttttatccagtgtttgtttcaccttgctccaaaatttattcanttttactagctccaaaatttgttcctcttt

SEQ ID NO: 57109 - DNA, 101 bp, rice(Oryza sativa)
  misc_feature (71): n=c or g
gcttgtgtagtttatttatttatcaagttgtttttttagataaaagtttttacgctcagctttactaaaancatctaccctataattcactcagtattaca

SEQ ID NO: 57110 - DNA, 101 bp, rice(Oryza sativa)
  misc_feature (71): n=a or t
ctttctttaaaatgttcatatttcgaacggacaaaattgtcagtatttcatttctcagttttaattttttnaaaaaatgagttttccttaaatccatagtg

SEQ ID NO: 57111 - DNA, 101 bp, rice(Oryza sativa)
  misc_feature (71): n=a or t
ttggtgaacaagttgaagtcagtcatcaaggaggaggaggagcagtggcagactatgcaccgtgatgtggngttcatcagagatgagttcgagatgatgca

SEQ ID NO: 57112 - DNA, 101 bp, rice(Oryza sativa)
  misc_feature (71): n=c or g
ggatgttgttggatcggaataagcatatatatccggttggaacatagattaagtaattattctatggaaantagtccgcgcatatacgcgggcatgtgcgt

SEQ ID NO: 57113 - DNA, 101 bp, rice(Oryza sativa)
  misc_feature (71): n=a or t
tttttttcaactcatccctctctctccttatgtcatccttatctcctctcctcatactcctctctctctcnctctcactcccggccaggagagtggcggtg

SEQ ID NO: 57114 - DNA, 101 bp, rice(Oryza sativa)
  misc_feature (71): n=c or g
gtttttaaatattggaacagagtgagtagaggacatgcacaaagcattgtaatacagttcatgtcaagctnattaacagatcataataagcatcgcgcaca

SEQ ID NO: 57115 - DNA, 101 bp, rice(Oryza sativa)
  misc_feature (71): n=a or t
aaaagttagataagttcgctggatatgaaaaagtgacataaattgtgatagttaatctacatgttgcctangtttgctaaacatttcagaatctagaacac

SEQ ID NO: 57116 - DNA, 101 bp, rice(Oryza sativa)
  misc_feature (71): n=a or t
gcctgttcggcgtgcctagatggcagccagcagctacagtaacaacgtacaatttctacgtagttgctgcngctgcagcagcagcgctgcacagccgctgc

SEQ ID NO: 57117 - DNA, 101 bp, rice(Oryza sativa)
  misc_feature (71): n=c or g
tttgtcgagtagtagcagtattcatttgtgtgattaattagtggtgagtaaacagtggtggtgagcagctntctctctctctctctctctctctgctgtgg

SEQ ID NO: 57118 - DNA, 101 bp, rice(Oryza sativa)
  misc_feature (71): n=c or g
ctcatgaaattgacattcaacacgatgttcatggccaaattttttgttaacattacattgcgtgtactatntaagggcatgcttggaagcttagtataatt

SEQ ID NO: 57119 - DNA, 101 bp, rice(Oryza sativa)
  misc_feature (71): n=c or g
aattgcaaacaaagtttttaattcatctgcttaggaattcacattatcacatatgagttaaaaggtctacnttatgtgcaagttcaaccaatcgaagcaca

SEQ ID NO: 57120 - DNA, 101 bp, rice(Oryza sativa)
  misc_feature (71): n=c or g
ccacctttttttatgcattttttgccctcaagcagtgtttcgctttttccaatgcactatattttcttatnatgcattaagttacttctcactgtgaatta

SEQ ID NO: 57121 - DNA, 101 bp, rice(Oryza sativa)
  misc_feature (71): n=a or t
gatgaatacatagtgattttctttatgggatagtgcgaggtatatttgggaacagagatagattcaagatngattcaagttggtgggcattggacaagtct

SEQ ID NO: 57122 - DNA, 101 bp, rice(Oryza sativa)
  misc_feature (71): n=c or g
gaatacaatcttcttccatcttgtcgtctcattcctcgagcatatcacattggccgtacagtgtttaattnaaattttttgttgtcttcgcgaaacttgaa

SEQ ID NO: 57123 - DNA, 101 bp, rice(Oryza sativa)
  misc_feature (71): n=c or g
caagttgccaaagctacctcgccttgccccaaagcctcaatccaaggtcttggtaatcctacttccaatanctatcgcagcattcatcctttctgtgggca

SEQ ID NO: 57124 - DNA, 101 bp, rice(Oryza sativa)
  misc_feature (71): n=a or t
ggtagttttacctgtttggaaataactagtaagaaattggagattggagaacacaatatagtggagtactntttatcggtgtaaattaaagatgagggcga

SEQ ID NO: 57125 - DNA, 101 bp, rice(Oryza sativa)
  misc_feature (71): n=c or g
gttgacatggcaaatacatataggcacttaacttagtggtgtgtatcatggcttcgaaaatactccctccnttccataatgttggattagacacgtctaaa

SEQ ID NO: 57126 - DNA, 101 bp, rice(Oryza sativa)
  misc_feature (71): n=c or g
tgccaataggatttacaaggtatcagctggtttgattggagagctgacctctcttgaagagatatggatanaggctgaaaatgatgacagaatacagttta

SEQ ID NO: 57127 - DNA, 101 bp, rice(Oryza sativa)
  misc_feature (71): n=c or g
tacagttgatgtatacaataatagtctctacaaggctcaacaatccaggcttggccaaccaatgaaattgnttttgcctggcccatcaagcataccgggcc

SEQ ID NO: 57128 - DNA, 101 bp, rice(Oryza sativa)
  misc_feature (71): n=c or g
gagacttcaatccattaactaaaaatatgcctgggttaagctacattatatgtggttgatggaagcagacnctctaacttaactgcacatacagttaagtc

SEQ ID NO: 57129 - DNA, 101 bp, rice(Oryza sativa)
  misc_feature (71): n=a or t
tctgctacacatgatacttaattattcaaatggaataagaatcgagaaacaaaaacaatcgagaaccaaanaacataacaacattatgtacttaaaagtta

SEQ ID NO: 57130 - DNA, 101 bp, rice(Oryza sativa)
  misc_feature (71): n=c or g
agaagaagagaagggagaagtagaaatcaaggaagcagcggcctccagcgcttgaaggtacgatgcctatnttaggattgaatttggacgccgttctcggc

SEQ ID NO: 57131 - DNA, 101 bp, rice(Oryza sativa)
  misc_feature (71): n=a or t
cctttctttttttggggtgggggaggggagggtctttttccacctctcacttcctctatcaattttgctcntctctcttttgcccctattcaattctcttt

SEQ ID NO: 57132 - DNA, 101 bp, rice(Oryza sativa)
  misc_feature (71): n=a or t
taaaaaaggcagttaagcagtccgtgaaaaaaatccatccaaataaaaaggcaaaaataaacaaaaaaaangccttcaaaagagaacagaacgtttccgtc

SEQ ID NO: 57133 - DNA, 101 bp, rice(Oryza sativa)
  misc_feature (71): n=a or t
tattgatatagtactcatattgtcataacacaagctctctctcaactcttgcatggcacgcgcatgatatnacttctaaaatccaacacggattcgcgtgg

SEQ ID NO: 57134 - DNA, 101 bp, rice(Oryza sativa)
  misc_feature (71): n=a or t
tccagaaaatgtcaaaattccaaatccttccaagttcatacttttccataaaagcatcccaatcgttatcnttttccttgctttctatttttctttttttc

SEQ ID NO: 57135 - DNA, 101 bp, rice(Oryza sativa)
  misc_feature (71): n=a or g
aatgaatataaattgattggagtgtggaaaccaaagtttgtaaagtgaacaagtgaagttcactaacctcncggaatctgcggaaaatcattgggatagta

SEQ ID NO: 57136 - DNA, 101 bp, rice(Oryza sativa)
  misc_feature (71): n=a or g
tttcctgtaatcgggccaccaatgccagactggccggcacctccttcaccatcggatgaagagaggtttcnagaagagctgtatcgagactacgatgatgg

SEQ ID NO: 57137 - DNA, 101 bp, rice(Oryza sativa)
  misc_feature (71): n=a or g
tccaaccttacagttcttgagaagctcgttctttcttccaacaacttctatggaccacttgctactaactngttctggggtataaccacccttagaaccct

SEQ ID NO: 57138 - DNA, 101 bp, rice(Oryza sativa)
  misc_feature (71): n=a or g
ctaggctctagctagccacgatctcgagtcgccggagaaaaagaaaaaaggaacaatctgcgagcaaagcnagctactggagacggaggcaggaatgaact

SEQ ID NO: 57139 - DNA, 101 bp, rice(Oryza sativa)
  misc_feature (71): n=t or g
tggcgttcgtgtctgaattaaccaacgcaaaataaacacgagtctgctgagacactgctcactgcttactntactcatggctcagcggcggctgctactcg

SEQ ID NO: 57140 - DNA, 101 bp, rice(Oryza sativa)
  misc_feature (71): n=a or g
atctttctaacacgtaaacgctaacgtggcataccacgtcagctcatgaagcgagttggagtccgcatttngacctatatgacacccataaaaagttcaag

SEQ ID NO: 57141 - DNA, 101 bp, rice(Oryza sativa)
  misc_feature (71): n=a or c
tcaacctcttttttctttaggtgtgcagcactatgcaaatcttcatcttgtccatcctcagtatatgagtnacacaaaatacttgtagatgcactgataca

SEQ ID NO: 57142 - DNA, 101 bp, rice(Oryza sativa)
  misc_feature (71): n=a or g
ctaccggacccatctgttgatcatattggttatgaagctgtctccaagtttatgatacatggcccttgtgncagttcaaacaaatcgtctacttgcatgaa

SEQ ID NO: 57143 - DNA, 101 bp, rice(Oryza sativa)
  misc_feature (71): n=a or g
atatacctcctgaaaaacttgtccaacaaaatttctcgggcagtaaccatggcattttcagggtgtgttcnaaccaaggtgttggaagcctctcctttcct

SEQ ID NO: 57144 - DNA, 101 bp, rice(Oryza sativa)
  misc_feature (71): n=t or c
ttccttgcgctttccaactcccttcctacattcttgattttcctattactccaggaacgcagggcatacantaactttagtcagtgtcaggttcacctctc

SEQ ID NO: 57145 - DNA, 101 bp, rice(Oryza sativa)
  misc_feature (71): n=a or g
caaacaccatgattgagggagaaaattgcgacatctttctctaataggtttgtcccaactaagaagaaccngagaaggaagatcgtaaaccaggaaatccg

SEQ ID NO: 57146 - DNA, 101 bp, rice(Oryza sativa)
  misc_feature (71): n=t or g
ttgatgaaagatcacaccagaaagaccagactgctctagtgccttgacagcttgagagcccttcttttcancccttgcagtcagcacgacaagaatgccat

SEQ ID NO: 57147 - DNA, 101 bp, rice(Oryza sativa)
  misc_feature (71): n=t or g
gattgtgaatataaggcctcaaaaaccaaggaaactaaccttcagcatccagactcactgattcaggaatntgctgctggcggatatcaacattagatgcg

SEQ ID NO: 57148 - DNA, 101 bp, rice(Oryza sativa)
  misc_feature (71): n=a or g
ttgcaaactatctggttccctagtatctgtcagacatgcataccttatagtcccatcggcgtatttcttcngcttgcgggtcccgtgtcttgatcttgtga

SEQ ID NO: 57149 - DNA, 101 bp, rice(Oryza sativa)
  misc_feature (71): n=a or g
gaggcattgtagttactaatgtaacttttcaaccaacacctcttccacctcctatgggcaatggttacatngcagttgacggtggcaatatggcagtatcc

SEQ ID NO: 57150 - DNA, 101 bp, rice(Oryza sativa)
  misc_feature (71): n=a or g
acttgccgcagtaggccgacatgattgacagatgagagaaacgaaagcttcttggaggagaggtgatcagnaggaagaggaagaagaagaagatgcagaga

SEQ ID NO: 57151 - DNA, 101 bp, rice(Oryza sativa)
  misc_feature (71): n=a or g
tgtgactttgacattggtgcggcaaggtatcatcaatcatggttttggcattactgacaactccgactttngccatggctctggcatctctggtgtgtttg

SEQ ID NO: 57152 - DNA, 101 bp, rice(Oryza sativa)
  misc_feature (71): n=a or g
tggaatgtttttccgcttatgttcaattttgacatcacttgagtcagtttcgaaagacgacttactgggancagcactagcctctggtggcaagattgagt

SEQ ID NO: 57153 - DNA, 101 bp, rice(Oryza sativa)
  misc_feature (71): n=t or c
tcagaaacctatgcacaattgttgaactttgagaacaggttaaacatgaggcgcgaaagcaatctggcaanagccaatgcagcagggcgcggacgtggaag

SEQ ID NO: 57154 - DNA, 101 bp, rice(Oryza sativa)
  misc_feature (71): n=a or g
cattatttatttcctactctatcgtctccgatctgaaccagaaccagaccaaacttcattctcgagtcagngaccggagtaggcgaaggccggtgcagtgc

SEQ ID NO: 57155 - DNA, 101 bp, rice(Oryza sativa)
  misc_feature (71): n=a or c
cttcaccccattgccttttgaagttgcaggaggtacaagttcaagcatatcaggctgtgcttgaaccacangggcccttccttctattgccttttcccaga

SEQ ID NO: 57156 - DNA, 101 bp, rice(Oryza sativa)
  misc_feature (71): n=t or c
cccgtgaaaaatgtctgaatttcgctaaaaatccctacataaattcagtttcgtgggcaatttaggagagnagagatgggattctcgtgaagctagatagc

SEQ ID NO: 57157 - DNA, 101 bp, rice(Oryza sativa)
  misc_feature (71): n=a or g
taataaagttaaaatgtcacaacctgattaagttaatcctctctaacccacatcctgttaaccctgaacanatgtagctaagagagaaatctcacaccaag

SEQ ID NO: 57158 - DNA, 101 bp, rice(Oryza sativa)
  misc_feature (71): n=a or g
gacggagtttgttgatgaggaaattgcagcggcaaatgatcatgagcttcttgttaatctagcaggcatgnttgcgcaatgtctaaatcttgaggtggatc

SEQ ID NO: 57159 - DNA, 101 bp, rice(Oryza sativa)
  misc_feature (71): n=a or g
ggtgctcttatcgttcccaactatgatgaagttctagcaacagctaaaaggaagtccattcttgatgggantaacgaactagccaaagataaggttttgaa

SEQ ID NO: 57160 - DNA, 101 bp, rice(Oryza sativa)
  misc_feature (71): n=t or c
tttgttcccgatgaaaaatatgcaggatcagcaacttcctatgggattgatacaaattggtacgtcgacancggtgcgactgaccatgtgaccgcgaactg

SEQ ID NO: 57161 - DNA, 101 bp, rice(Oryza sativa)
  misc_feature (71): n=t or g
aacagaacaccagtagacgctattgaagtaccaaaagttattgaagtgaagagggatgaacatggtaatgnacagactaattgtctacagtcaccaaggaa

SEQ ID NO: 57162 - DNA, 101 bp, rice(Oryza sativa)
  misc_feature (71): n=t or c
tgtggggatggctcgggctctcctcaagcagagagagatgctggccgtcttctggaagaggtggtggtganggctgtctacatcctcaaccgctcgcatac

SEQ ID NO: 57163 - DNA, 101 bp, rice(Oryza sativa)
  misc_feature (71): n=t or c
tgcttgatatcaccagcagattggttctgctgattaggtgctgcctgactatttttgttctctcttcggcnagatgcttctttactaatgattgaagaact

SEQ ID NO: 57164 - DNA, 101 bp, rice(Oryza sativa)
  misc_feature (71): n=a or g
agaggagatgacgaacacaaaacttgtcgagaaagaaggtatttttccagctgacgaagggaagctccggnaagcatggctacttttttgggggatgttgc

SEQ ID NO: 57165 - DNA, 101 bp, rice(Oryza sativa)
  misc_feature (71): n=a or g
tgtactccatgaaagtagtcactctggttctcctgagtcgacccatctgtaatacctttgtcactcggctnggctgatccgtctggaacttgtttcttttc

SEQ ID NO: 57166 - DNA, 101 bp, rice(Oryza sativa)
  misc_feature (71): n=a or g
ggtttgtctccaagattcaaacggaggaaggtggtgaaatccgcgacctgacctggctagcatggaagacnccaacgagaacctggcccagcaaggagatg

SEQ ID NO: 57167 - DNA, 101 bp, rice(Oryza sativa)
  misc_feature (71): n=t or c
atcccgctctccaccacgccattgctcgccgtcgtggcggcgggcaggagtggtcggatgatgccgaaganggagggcggtcggcggccggatgacggcca

SEQ ID NO: 57168 - DNA, 101 bp, rice(Oryza sativa)
  misc_feature (71): n=t or g
tcggcagtgcgtaggtcatgggtgctcgttggttcaaagatcagaatcgatgctaaagagcaaagcaggantgggctgccatttcccataatttctggcca

SEQ ID NO: 57169 - DNA, 101 bp, rice(Oryza sativa)
  misc_feature (71): n=a or c
attacaccctgctatgatgaagattattgctttctttttttaacttacctgaagtccataatgtacttggntttgccaatcctaccaagctgcaatattgt

SEQ ID NO: 57170 - DNA, 101 bp, rice(Oryza sativa)
  misc_feature (71): n=a or c
tgttcgagaagaagaaaattcgaggtttgattcctgaaaaattgcacctgaaaccccttttaaagctgaanccataaattcagtacaattcagtctataga

SEQ ID NO: 57171 - DNA, 101 bp, rice(Oryza sativa)
  misc_feature (71): n=t or c
gttagtagctcaaagctcgtgactgttttattgagatttaatggaacatgacgccttagtgcagccatatntatttgagagagaataaagtattcagaaac

SEQ ID NO: 57172 - DNA, 101 bp, rice(Oryza sativa)
  misc_feature (71): n=a or g
atctgatggctggattaagcttctatttatcagctcgtcgaggaatctctccccctgctcaaataacactngccccttttcctcgtggacaaaaccttcag

SEQ ID NO: 57173 - DNA, 101 bp, rice(Oryza sativa)
  misc_feature (71): n=a or g
cgactccacatgttgctggccacgtccaaacagtaggttcctgcgtcctcagccgatacgaggatgcgccncgaaccgtcgtcatcgccggcaaccacggc

SEQ ID NO: 57174 - DNA, 101 bp, rice(Oryza sativa)
  misc_feature (71): n=t or g
cttgaaccaatctgatctaagaaagcaaatttcaggtaccgtattaccttgatgaatccagaggttggagngtgaacatttcagatctgaagaaacagttg

SEQ ID NO: 57175 - DNA, 101 bp, rice(Oryza sativa)
  misc_feature (71): n=a or g
attggctgaattaaccacacatctgccctttaccaagtcgacagaagggttttgccggatttggaacagtntgtctacatagcttacaatgaatctctttg

SEQ ID NO: 57176 - DNA, 101 bp, rice(Oryza sativa)
  misc_feature (71): n=t or c
cgctcaatagcaaagtccattttatgtcccttaactatacaaattgagtttgtgccacatccctcaaccgngaaatcaggtgtcgtcccacaacttctaaa

SEQ ID NO: 57177 - DNA, 101 bp, rice(Oryza sativa)
  misc_feature (71): n=a or g
atcgagatatctgattttgcatacatgcacgccaagatattgacaaaagacatatacctggaaaaggacgnagaacttatgtcgttgtgtgctttgccctg

SEQ ID NO: 57178 - DNA, 101 bp, rice(Oryza sativa)
  misc_feature (71): n=a or c
gtaccaaccaacttgggccgtcatattcatcggtgttttccacaggcacttcatgcatcacttatgctacnaaacatgcacatagttaggtttttgtgata

SEQ ID NO: 57179 - DNA, 101 bp, rice(Oryza sativa)
  misc_feature (71): n=a or c
actatacgtgtacttcagtttactttgccagccatgcaacatgtagattgtgattatgcatgcatgccccnatgcgatttggccgtgtggggttaaccaaa

SEQ ID NO: 57180 - DNA, 101 bp, rice(Oryza sativa)
  misc_feature (71): n=a or g
cctcgtccaaactaaagaaacaattaagctccatcggagacggtcattatctatagagtaaagtgcacggncggtctctaaacttgtgtgggtgtgtcaac

SEQ ID NO: 57181 - DNA, 101 bp, rice(Oryza sativa)
  misc_feature (71): n=a or g
tatgcctgcagattacacatacatccttagagataaggaaaatggttgtcgaaatatgcgatatcgtggcnaggagggcagctcggctggctgctgctggt

SEQ ID NO: 57182 - DNA, 101 bp, rice(Oryza sativa)
  misc_feature (71): n=a or g
gtgagtattatatacaatattggagaggtattggcttttgttagagttgatgcactgctttaatgcgatgntcaattgggagctgaggcagtgcttaatta

SEQ ID NO: 57183 - DNA, 101 bp, rice(Oryza sativa)
  misc_feature (71): n=a or g
agaagcgtcgcaaaagaatcaaagctgctgggattgattacgagtgtccaccccttgtaagtaacactgcncttcttgctttttggttgatcaaattgctt

SEQ ID NO: 57184 - DNA, 101 bp, rice(Oryza sativa)
  misc_feature (71): n=a or g
acaaagtctacatacgcaaatgccatttacaaatccatcacaccagccatccttgtacttggcatgatggnctttggcatcggccaggcaagcaaccttgc

SEQ ID NO: 57185 - DNA, 101 bp, rice(Oryza sativa)
  misc_feature (71): n=a or g
ttgcttggtatactgctgcttttgatgctggacctccagctatatgctactttgtctgatccaaaatgttnctaccccatcctaggacttatgtccagatt

SEQ ID NO: 57186 - DNA, 101 bp, rice(Oryza sativa)
  misc_feature (71): n=a or g
accggttttcccaaccagcacaatgaatgcggcactgattactcagctgacaccaatgttaatcttaaaangaaaaagtacgaattaccctcccccgaact

SEQ ID NO: 57187 - DNA, 101 bp, rice(Oryza sativa)
  misc_feature (71): n=a or g
ttgcttgagtagtggaccatccccaattattgttgcccggtgtgtgtgaccacttgcatttatattgttgntgtttagatgtgttcgagtcccttcgttgc

SEQ ID NO: 57188 - DNA, 101 bp, rice(Oryza sativa)
  misc_feature (71): n=t or c
ggactaacatcaatatagcaccagatgagaaagtggagtcatttgaactggattatgatggaaagcgtgancgctggaacggttacgacccatcgacgtac

SEQ ID NO: 57189 - DNA, 101 bp, rice(Oryza sativa)
  misc_feature (71): n=t or c
gcataggcccagttaggtcattgtgtgagagcagaagggatgtcaaaatggatgcattccctattaattcnggcgatatctccccattgagcatgttaaat

SEQ ID NO: 57190 - DNA, 101 bp, rice(Oryza sativa)
  misc_feature (71): n=a or c
aggctagcctgtttagcagcaaagaaagatcggtccccttccgagatgtctgcctgagatgatttgcattnaataaagggttattgttatttcaaatgaag

SEQ ID NO: 57191 - DNA, 101 bp, rice(Oryza sativa)
  misc_feature (71): n=t or c
tagcagtaactaaactttttttcttttgttctttttggcaattttcgatcggcgacgctagaggaatggangaccactaatcaatctagacataaaaaaaa

SEQ ID NO: 57192 - DNA, 101 bp, rice(Oryza sativa)
  misc_feature (71): n=a or c
ggtggaggtcctcgtggatgaagcggaagtaggccgggcaggaggagttggtggtggtaggggggagtggntggggctcggggacgcgggcgcaggctggg

SEQ ID NO: 57193 - DNA, 101 bp, rice(Oryza sativa)
  misc_feature (71): n=t or c
ctgccacgcgcctcccggcctataaagagatgaacaagagaaggaaagaggatgatggcccagggttaaanatttccgtttagccgatttgatcggacctc

SEQ ID NO: 57194 - DNA, 101 bp, rice(Oryza sativa)
  misc_feature (71): n=t or c
tctcatctcatcagtttgtttcttctccatggacaaattctatcaatccaagtagcgttttggttacaggnttctcctcattaagttgttattacagcgac

SEQ ID NO: 57195 - DNA, 101 bp, rice(Oryza sativa)
  misc_feature (71): n=t or c
gccgaccttgcgtgagacatcgatcggcgctgagccacgactctgagcgagtgatctgcgccctaaccacnagcgtcgtccacgggtggcgggccacctcc

SEQ ID NO: 57196 - DNA, 101 bp, rice(Oryza sativa)
  misc_feature (71): n=t or c
tcaatccaaattaatcaaacgcaggtcaaatctaattctaatactcactgtagagatgggtataacgactngactccttcaattattaaaacatgtataga

SEQ ID NO: 57197 - DNA, 101 bp, rice(Oryza sativa)
  misc_feature (71): n=a or g
ctgctccgtacagctaattcttcaccatcaacctactccatcctctctgctcactctgaattctcaaggtntagttctcatcaggtagatggccatggaag

SEQ ID NO: 57198 - DNA, 101 bp, rice(Oryza sativa)
  misc_feature (71): n=t or c
tgtgtcaagattgtgctgggagcataaagctgggatctttggccaggttcttgactatctaaattgtttgntgttgctatgtactaattacccttgcattt

SEQ ID NO: 57199 - DNA, 101 bp, rice(Oryza sativa)
  misc_feature (71): n=t or c
ccgcgcctttctccttcgacagatttacatgctccttccccgtggtccttttgtagaaccacagatttctnattcaagccttctttcacaataaggtgttg

SEQ ID NO: 57200 - DNA, 101 bp, rice(Oryza sativa)
  misc_feature (71): n=t or g
gtgctactcctacatagtagtaataccgccatcaacatatgggtctttccgcatgaaatgattcctcgganccaaaaactctactacactttgctgctagc

SEQ ID NO: 57201 - DNA, 101 bp, rice(Oryza sativa)
  misc_feature (71): n=t or c
aatatctttgataagtttaagtactgcagtttggtgagcccaccaaagacttgtttgaaatcttgtacccnggagcagcctgacaggtcaagatgtaccaa

SEQ ID NO: 57202 - DNA, 101 bp, rice(Oryza sativa)
  misc_feature (71): n=t or c
ccgtgcagacgtggacgaagatgaaaaaactcgagctcgctagcgaagtccattccgactcgccagccgtntataaaaggcaggcgttacgcgctatcgtc

SEQ ID NO: 57203 - DNA, 101 bp, rice(Oryza sativa)
  misc_feature (71): n=a or g
taattagccaacctcgcacttgattagtttgggtaattaaggtaagcatcaagtgctaattagagagaganaaattgaattaaagatgccattagttaagg

SEQ ID NO: 57204 - DNA, 101 bp, rice(Oryza sativa)
  misc_feature (71): n=t or c
gctctaggatttccttcctcctagatttcctttcgccctgttgccagcattaagagcaaggataatagtanagctcactttctactattagcccattttaa

SEQ ID NO: 57205 - DNA, 101 bp, rice(Oryza sativa)
  misc_feature (71): n=a or g
gttaccctggtgcatatcccctaatgcaaggataccctaattcacctggacaatatccgactcccggtggntaccctagtgcaccaccgggacaataccca

SEQ ID NO: 57206 - DNA, 101 bp, rice(Oryza sativa)
  misc_feature (71): n=t or c
gacgagtttggtttctgctgaaaaagaatccatcgaacacttgttagttgacttgaccgggcttgagcgantcagtacacggtggtagtccgtctctgtgt

SEQ ID NO: 57207 - DNA, 101 bp, rice(Oryza sativa)
  misc_feature (71): n=a or g
ctgtacacttttggtacttgcaaaacagatttatgacagtgtccggttccttgtttgctcagttcattcgnctctttgcataatactctcttgtttcactt

SEQ ID NO: 57208 - DNA, 101 bp, rice(Oryza sativa)
  misc_feature (71): n=t or g
atgccaatccgcaacatcctctcccaaacgatcttctttgacctccgtagttctgtagtttagagcataantaatattgtcaactcagatgtgttgcattc

SEQ ID NO: 57209 - DNA, 101 bp, rice(Oryza sativa)
  misc_feature (71): n=t or c
atcgccgccggtaccggtgacaacctcttcctcttcatcatcttttccctcactgccatgctccgggtggncaccatggtgccctacgagtgagacactta

SEQ ID NO: 57210 - DNA, 101 bp, rice(Oryza sativa)
  misc_feature (71): n=t or g
ggaaggttcttgcggtgctagagcatgcaaaccaagcagacaaatccatcaaatctttgtggccaagaacntgacaaaggaaaggaagcaaaagatttgac

SEQ ID NO: 57211 - DNA, 101 bp, rice(Oryza sativa)
  misc_feature (71): n=t or g
ataagagttaatcattacaattagatcttcaacacaaatgctataaataaacagtccaatacgctgatagntcttctccggtaaaaaataataattaggat

SEQ ID NO: 57212 - DNA, 101 bp, rice(Oryza sativa)
  misc_feature (71): n=t or c
aatgttctagcaataggtaaacacccaattgggggcactccaacaaagacaaatctccttcctccaagtgntgccatcacctgagtaacatggcaatgatt

SEQ ID NO: 57213 - DNA, 101 bp, rice(Oryza sativa)
  misc_feature (71): n=a or g
agaggctggctcgcatgaaaaaatcgattttcacatgcaaaaatgaggtcatctggcgtggctggtggccngctagggtttcggcttttttttttgaattt

SEQ ID NO: 57214 - DNA, 101 bp, rice(Oryza sativa)
  misc_feature (71): n=a or g
gttttttttttctcaaatgcatggtggatcccccaggcatgacaacggctacacgatagaaaagaagagtngagtacacccatccgtctaataaaaaatct

SEQ ID NO: 57215 - DNA, 101 bp, rice(Oryza sativa)
  misc_feature (71): n=t or g
aaagtgcgctcctatttcatctctttggtttgcatgctgtggcttgcattctttcaagataactgtagctnaggttgctcgatatgaacctgcttgcttgt

SEQ ID NO: 57216 - DNA, 101 bp, rice(Oryza sativa)
  misc_feature (71): n=t or c
ctctcagatcgaggatcgagctgctccttttgctgctatgttagtactttgggttagagactactccctcngtcccagaaaataaacatttttagagttgg

SEQ ID NO: 57217 - DNA, 101 bp, rice(Oryza sativa)
  misc_feature (71): n=a or g
ccgccgaagcttgatgaactaaacttcctccgggaggtgcatttggctcaaatgcctcaaggattctatgncggcatgaagccagcaaccaagaagctcgt

SEQ ID NO: 57218 - DNA, 101 bp, rice(Oryza sativa)
  misc_feature (71): n=a or g
cggtagggatgcgcctgcaaggctgcagggcggtttaaaaaatttactgcggttatgttttttttttaacnactcgcacaagacggtgcgatattctattt

SEQ ID NO: 57219 - DNA, 101 bp, rice(Oryza sativa)
  misc_feature (71): n=a or g
tcccctgcatccctctctaccctgacccccttctaaaaagaaaaagaaaattataccccgcgtgccaaaanaaaaattcgtcaaggtggttctttgccaaa

SEQ ID NO: 57220 - DNA, 101 bp, rice(Oryza sativa)
  misc_feature (71): n=a or c
tgtttggcactttggcaacatgttcaccactgatttaatgtccctagctagacatgcaaaggttaaactgnatgtttatgccttctttttgtgaaccagtt

SEQ ID NO: 57221 - DNA, 101 bp, rice(Oryza sativa)
  misc_feature (71): n=a or c
ccacctatcgatgatgatgaagacaacgaaggataactataatcgggagtacgacctctggatctatgccnatgtccttgatttctccgagaaccggggga

SEQ ID NO: 57222 - DNA, 101 bp, rice(Oryza sativa)
  misc_feature (71): n=t or g
agttgcaagctgttgtacttgtaccgatgataagtacaaggtgtctgagattcaacacgaagggtcatttnccaaacctctttatgtcttctacaaggagg

SEQ ID NO: 57223 - DNA, 101 bp, rice(Oryza sativa)
  misc_feature (71): n=a or g
tactttcatggacttcggatgtatacccttcgtggattaaaccttgcaggaaatcatttcaatttaacggntgagttctcaagcacgagtcacactggagg

SEQ ID NO: 57224 - DNA, 101 bp, rice(Oryza sativa)
  misc_feature (71): n=t or g
cacctgcaatttatgtgcagaaattcgagaatcatgtccaacagaaattcttaaacgtctccatccatccnctttcttcttgtttaataaccatgcagcaa

SEQ ID NO: 57225 - DNA, 101 bp, rice(Oryza sativa)
  misc_feature (71): n=t or c
ccaagaacatcatatggtccacccatgtgaacaccagaaccaaccacaccattgtagtgttgttgaacaangggaatcttgtactgcagagctcctcaaac

SEQ ID NO: 57226 - DNA, 101 bp, rice(Oryza sativa)
  misc_feature (71): n=a or g
ccaaaccgaccataaaaattggatggtatcctcaattccccatcctcctgctttgattatccgacctgacnggctatagcgtggattgtatcaccatcctc

SEQ ID NO: 57227 - DNA, 101 bp, rice(Oryza sativa)
  misc_feature (71): n=t or c
ttctcaccaagaagataacactgcacagggccccatatcactcaaataggtgccagatcttggtgagaacnggcacctattgttttgcaccacactaatcc

SEQ ID NO: 57228 - DNA, 101 bp, rice(Oryza sativa)
  misc_feature (71): n=t or g
ttgctgcacatggagatgaagaaggccttccacttggtaaagttgggatgcttgagctccagggtgattgngatgtgagtcttgacgttgatggcggcata

SEQ ID NO: 57229 - DNA, 101 bp, rice(Oryza sativa)
  misc_feature (71): n=a or g
atagtcactggaaacggtgaagtgtattatctttcttttattttttctggatccccgttacatggccctangagcctatttataaccctattactagttcc

SEQ ID NO: 57230 - DNA, 101 bp, rice(Oryza sativa)
  misc_feature (71): n=t or c
ttgaaagttatggacctatagtttatcgtcggtgagcttggtgccgagatttcatgtgttgagtcagatangttggagccaaatccggtggtgatgcaaac

SEQ ID NO: 57231 - DNA, 101 bp, rice(Oryza sativa)
  misc_feature (71): n=t or c
ctgaggtttatagagatataattaagatagaagatctagtgcactcagtgcatggagaacgatcagtagcntattaggattctttttatacttaatgaact

SEQ ID NO: 57232 - DNA, 101 bp, rice(Oryza sativa)
  misc_feature (71): n=a or c
tttgtcgtgcatggccttgtcaaccgaacacgtagctgttgtccagcgacctgaacacggtgggctcctcntccatcgccaccgccaactccggcgacacg

SEQ ID NO: 57233 - DNA, 101 bp, rice(Oryza sativa)
  misc_feature (71): n=t or c
tcccgagtgaactcttgaactaccagtttctcaactcgctcaagctctctggcaactctttcgaccataantttgaatccctcggccggcttggccatctt

SEQ ID NO: 57234 - DNA, 101 bp, rice(Oryza sativa)
  misc_feature (71): n=a or g
ggattaatcaagcttaatctcaccactaatcaatcatcaccaccatctaatttaacgaccacggtccagtnggcccacccccacacgtgggcccccacctg

SEQ ID NO: 57235 - DNA, 101 bp, rice(Oryza sativa)
  misc_feature (71): n=t or c
gacaaagagaagtgagagaggcaagagagatagcgataatgccgatgctcactcattcgtatggataaggncgacgacagatctgctcaacaaatctataa

SEQ ID NO: 57236 - DNA, 101 bp, rice(Oryza sativa)
  misc_feature (71): n=a or g
attcaatactggaagctgaaaagggaagagaatacatgaattatatgacctccagcatcctttagatcacncagtgtttcgtaagccccagcaggcagacg

SEQ ID NO: 57237 - DNA, 101 bp, rice(Oryza sativa)
  misc_feature (71): n=t or c
ggtagctgcagtgcagcgcagccaacagtgttatatcctgctgctgtcttgcaacatacttcctccgttcnaaaaaaaaaagtcaaaccctgagttttgac

SEQ ID NO: 57238 - DNA, 101 bp, rice(Oryza sativa)
  misc_feature (71): n=a or g
gtaatggaacttcaaaaacttatatctggaagagaacttttcaccatgagcagtagtgtctggagaaatantggatgaagtagtacaagccgcagattgat

SEQ ID NO: 57239 - DNA, 101 bp, rice(Oryza sativa)
  misc_feature (71): n=t or c
ctcgcgttcaagttctacatttgaaacatgggtactcgcatgtagatgagcgatatatgcccgtcgacatngagacgcctatggtgatttcgtgaatctct

SEQ ID NO: 57240 - DNA, 101 bp, rice(Oryza sativa)
  misc_feature (71): n=a or c
cagcaggagcaacagccatcgcagttagttgatcgatcgatgatgacacaaggctacattggagatctttnttacattcagaatcaatttgatcaacagca

SEQ ID NO: 57241 - DNA, 101 bp, rice(Oryza sativa)
  misc_feature (71): n=a or c
attaatatattaggaagtgtacgtaagcatccatatataaatgcacgtagacatacctttgcccatgaagnaagcagtatatgtatatggaatttatagtc

SEQ ID NO: 57242 - DNA, 101 bp, rice(Oryza sativa)
  misc_feature (71): n=t or c
agtagcaatgtactgtgcaaaacgatttcatgttatgcttcgcgaggaagaaagctttctcaacaatctgncctatgcaattacatctgtgtgctccaggt

SEQ ID NO: 57243 - DNA, 101 bp, rice(Oryza sativa)
  misc_feature (71): n=a or g
aggtttacttttggaatcaacatcagctagctagagatgctcagtaatttagggaaagaaaattaacgacnagaacacaattaagtgatgttcaatgataa

SEQ ID NO: 57244 - DNA, 101 bp, rice(Oryza sativa)
  misc_feature (71): n=a or g
atgtgcagggacttgcaggttacaaagcatatgaccttacattgcgaggttgtgcgtttcatgcatctccnttgctgggagaatttgtgctgacataacct

SEQ ID NO: 57245 - DNA, 101 bp, rice(Oryza sativa)
  misc_feature (71): n=a or g
tatacaaaattttcagagatggtagggaacaagctgaagtttgaattgaagaacaatctgtttttgaaacnatggagcccctattcatatttgaaattcat

SEQ ID NO: 57246 - DNA, 101 bp, rice(Oryza sativa)
  misc_feature (71): n=t or g
aagcagctataagtttaaggtgtttgctatggagaagatgaagtgtatgtagaagaagaagaagaagctanaagcttacaaggtgtgtttgatagctatgg

SEQ ID NO: 57247 - DNA, 101 bp, rice(Oryza sativa)
  misc_feature (71): n=a or g
tcctggagaaaggagtactcatttgacacgacgtaatgcacgatatgcaactaggcgtgacaaaccatgcnctgaatccattgcattggagtgccctaagg

SEQ ID NO: 57248 - DNA, 101 bp, rice(Oryza sativa)
  misc_feature (71): n=t or g
catgaggggactagtctgatgtatgaataagtgagtgcaaatcatgttcctccgcagaacaaaaaaaaagntgagtgcaaatcatgaactcaataaatttt

SEQ ID NO: 57249 - DNA, 101 bp, rice(Oryza sativa)
  misc_feature (71): n=t or c
tactttatattttgatacggagggagtatctcgctttttcacggagtccgatcagttttggttggctttangaaccttgaacatatgtattaaggtggtgt

SEQ ID NO: 57250 - DNA, 101 bp, rice(Oryza sativa)
  misc_feature (71): n=t or c
aagggctctcacgaattctccaagctatagaaagataaaccacatccctcccactccaacccctcttcttncttgatttcggtggcctcgtcgccgaccac

SEQ ID NO: 57251 - DNA, 101 bp, rice(Oryza sativa)
  misc_feature (71): n=t or g
ccatggatcatatgacaacaccagcagcaaagatgagtagtatggacattggacgctatgacaattactangttacttataatgaccaagactacaatact

SEQ ID NO: 57252 - DNA, 101 bp, rice(Oryza sativa)
  misc_feature (71): n=a or g
tttctcaagctggtttttagatcaaagagcttgcttatatagcatagccggatgattaagcaccaagcganctccagggccttgtatcagaagcccatatt

SEQ ID NO: 57253 - DNA, 101 bp, rice(Oryza sativa)
  misc_feature (71): n=t or c
agagatcataatctttgagatcgccgtgcttagctggccaagattctgcaaaagatacctaagctagatanaaatcgttcttgttggagtacagacatgaa

SEQ ID NO: 57254 - DNA, 101 bp, rice(Oryza sativa)
  misc_feature (71): n=a or c
aaattaagcatcatacccattgtgttcacaacgttgacacatagcaaggctccctgctcaccatcccttcnaattaatttcatcattttaggtgcatgtaa

SEQ ID NO: 57255 - DNA, 101 bp, rice(Oryza sativa)
  misc_feature (71): n=a or g
ccgatctggaaatctctcactccacctcgatgccggtacttcgtctggttagtggtgcttaacaggtgctngacgggtgatcgattgaggaggcgcgggct

SEQ ID NO: 57256 - DNA, 101 bp, rice(Oryza sativa)
  misc_feature (71): n=a or c
acacgagatgggccggcacagtgcacggggctacagctcactttgcaggaaacttagttagtgggttatgnggtggcccatgtaggataagaagatggtct

SEQ ID NO: 57257 - DNA, 101 bp, rice(Oryza sativa)
  misc_feature (71): n=t or c
ctcttcaaaggtgccaccttcttacgaaattaggcacctatggccggtcccaaccaacgcctatacatccncttttatgtagtagtgtgtgtgtgtgtgac

SEQ ID NO: 57258 - DNA, 101 bp, rice(Oryza sativa)
  misc_feature (71): n=a or g
cactaatgtcggtatcctaaagttacttactccctccgtcttataattataatatagcaatctagtactgnatgtgacacttcataatataacgaatttaa

SEQ ID NO: 57259 - DNA, 101 bp, rice(Oryza sativa)
  misc_feature (71): n=t or c
gcgattgtctaaacgcactaccccttctttccgtaattactatcatcaaattaactaaactgaaccaaacnttacgcacttcccaaaccataagcccttgg

SEQ ID NO: 57260 - DNA, 101 bp, rice(Oryza sativa)
  misc_feature (71): n=t or c
ggcgaaattgctctattctctgtctaataagagtaggtgaaatattcacgcgtctccataaaccttgtgtntatcaaaaaagcttggacgtccctttctag

SEQ ID NO: 57261 - DNA, 101 bp, rice(Oryza sativa)
  misc_feature (71): n=a or c
ctgtagttgtaactcatggagacatcattggcaaatccagaggcaaaaacttcaagcccaagggcatgtgnatccttgaccaaactagtaggcagccgcag

SEQ ID NO: 57262 - DNA, 101 bp, rice(Oryza sativa)
  misc_feature (71): n=a or g
tctaaaattttatttttaaatttaagaattaacacatgccactgttagtgctctataaagaatgtacgatnatttaagatgatatagtaattattatcaat

SEQ ID NO: 57263 - DNA, 101 bp, rice(Oryza sativa)
  misc_feature (71): n=a or c
cttcccttgggattcttcttgcatcaatttctcgactgcaactcgtcgtcccacaatctcctttgggaagnagtaacgccagcatccgagtgtcgccttca

SEQ ID NO: 57264 - DNA, 101 bp, rice(Oryza sativa)
  misc_feature (71): n=a or g
tagcattataggtgtgtatcactcaaaaagaatattagagctatgatgattaaatgaaggtaattcaagcntaccaaaatagagcttgatgataacgatgg

SEQ ID NO: 57265 - DNA, 101 bp, rice(Oryza sativa)
  misc_feature (71): n=a or g
ggatcatagtacatcttaattaatttactttacggtgtgtacatatatggccatcgcacatactctctccntccctaaaaaaccaatctagaaatggatgt

SEQ ID NO: 57266 - DNA, 101 bp, rice(Oryza sativa)
  misc_feature (71): n=a or g
ttaaacacctaccattaccaacaacgcctctacttcgcccaaaaaaaggagaaaaaactctacttcacccntagaggttaatccaattttgacatatggcc

SEQ ID NO: 57267 - DNA, 101 bp, rice(Oryza sativa)
  misc_feature (71): n=t or c
ggccaccccagttttgtcatgtcctgctcattcactaaccaggtaaaatatgatgaccagtatctattgtntcactaaacatgctgagtatagctgtaagt

SEQ ID NO: 57268 - DNA, 101 bp, rice(Oryza sativa)
  misc_feature (71): n=a or g
ctactaaattaaacttccacgactacaaatttcacttagaaatttttgaattttcggaaacttcagacccntcacaaaacgattttatccaaaattttcaa

SEQ ID NO: 57269 - DNA, 101 bp, rice(Oryza sativa)
  misc_feature (71): n=a or c
ccgccgtcgccgttgtcgttgatcagcatcgccgagcaatccttgaacgggcagtagcacttcgtcgtctnccccatcgaggactcccacagcgagacgct

SEQ ID NO: 57270 - DNA, 101 bp, rice(Oryza sativa)
  misc_feature (71): n=a or g
ttcaaacaccaccttaatactacctccatcctataaagcatgtcgttttacagataaaaaatatcccacanaagctgtcgttttaacatcttcacaggaaa

SEQ ID NO: 57271 - DNA, 101 bp, rice(Oryza sativa)
  misc_feature (71): n=a or g
gctaaataacggtatatatcccgttcggatgagatgatacatccgaagtattatgtcctcataccaaaccngtataaggtgatacttgcgaggtatcaagt

SEQ ID NO: 57272 - DNA, 101 bp, rice(Oryza sativa)
  misc_feature (71): n=a or g
ctatcagagtaagacaatttaccttaatttaatcctgattcctagctactactaagcggctaagaagtaanaaagatcctagctttggttccaagtcaagg

SEQ ID NO: 57273 - DNA, 101 bp, rice(Oryza sativa)
  misc_feature (71): n=t or c
gctgctggaaaagggaatcgagatcgagacgaaggattggagccaacgggccaagaattaccaatacgctngaggggcaacactttcggatataggtgagt

SEQ ID NO: 57274 - DNA, 101 bp, rice(Oryza sativa)
  misc_feature (71): n=a or g
tcatgttagatttccggggtggggagaattctgtcatgcagtttcaacaaagtttgacatggatcaacacnagttgttgatccgtcagatggatgccatta

SEQ ID NO: 57275 - DNA, 101 bp, rice(Oryza sativa)
  misc_feature (71): n=a or g
gcctttgcatggcgcacagttgaagaatgacaagagaaaataagatgaagagagagatcaacgggactacntatcccaccgtctacaataataatatctta

SEQ ID NO: 57276 - DNA, 101 bp, rice(Oryza sativa)
  misc_feature (71): n=a or g
gcagtatatatgggcctaccaaaaacactccaagctttgtgcaaagcgagaggctcccatcggatggcctnttcagtcaaagaaaaggccaaaatttaaat

SEQ ID NO: 57277 - DNA, 101 bp, rice(Oryza sativa)
  misc_feature (71): n=t or c
tacgcctaagaagcggtggcacaacagacatcttcgtggtgctgggaagcgacggcatgaacatttttggnccttgacacgatcctcgcctcagtgagcga

SEQ ID NO: 57278 - DNA, 101 bp, rice(Oryza sativa)
  misc_feature (71): n=a or g
ggagcggaactagtctgcttaggtcattgaaagcgttggcatctcacgcagctcaaccatataagggctgntttggtttgtggccatatcaatatttgaca

SEQ ID NO: 57279 - DNA, 101 bp, rice(Oryza sativa)
  misc_feature (71): n=a or g
tttaataggcgttgtatccattagcaaataatcacgtttatagggtgttttccctcaagagtgagttcatncggtatcctatagctaaaaccatgtgtatg

SEQ ID NO: 57280 - DNA, 101 bp, rice(Oryza sativa)
  misc_feature (71): n=t or c
gctaacctatacccgtgtctgtgtgatgaacgttaaccccgtatgtaatcaacgattctggctgtgttctntgctcagtgttatcaactcatcttcctcat

SEQ ID NO: 57281 - DNA, 101 bp, rice(Oryza sativa)
  misc_feature (71): n=a or g
ataagcagcagccagtcggtgagagggagtaaggttcttttggcatgaaactgaaggtgagaaatttccancattggtggtaacttgatgggaatcagcga

SEQ ID NO: 57282 - DNA, 101 bp, rice(Oryza sativa)
  misc_feature (71): n=a or g
tattttatcgcatgaaatagctaaggcttacactacttgtgttgtatgagtgtgtagaatggcatgcatcntccttagttttgcaaatttagggtcctctc

SEQ ID NO: 57283 - DNA, 101 bp, rice(Oryza sativa)
  misc_feature (71): n=t or c
tttgccgaagatttccaacatggatggagtcatcttctctctgcaatgtgacatggttgaaacttattgantgcaggttctgcctcaaatttccaccactg

SEQ ID NO: 57284 - DNA, 101 bp, rice(Oryza sativa)
  misc_feature (71): n=t or c
ttatttggccatgcatggatggtcatcaccatgatttgccttctcggtgttctgattgctgccctccttgnctttgtgggagtctcttgttcggacgtacg

SEQ ID NO: 57285 - DNA, 101 bp, rice(Oryza sativa)
  misc_feature (71): n=a or g
ctgtcttgtaagagctactgaaaaaggtttattcagtcagctggcacaaagaaaggtagtatctgtcacanctcacaatgattcgaatttaactctatggt

SEQ ID NO: 57286 - DNA, 101 bp, rice(Oryza sativa)
  misc_feature (71): n=a or c
atgtcccggtgcatatatagcctggatccatgatatttgtgaacggaggtagtctattttaataatataantaaatgaataaaatattatttataatataa

SEQ ID NO: 57287 - DNA, 101 bp, rice(Oryza sativa)
  misc_feature (71): n=a or g
catagaagggctcgttttaaccataatatttctcctaccgactaccagccactcatcgaacaaatccacancacatactacgcgcgaccgctgataagata

SEQ ID NO: 57288 - DNA, 101 bp, rice(Oryza sativa)
  misc_feature (71): n=t or g
atgtttctgcattaaaatttgtagagacagaaacccaaatcacggttttaaaatgttccttgatcctgttntctttggcgataagctgagccaaagtggtt

SEQ ID NO: 57289 - DNA, 101 bp, rice(Oryza sativa)
  misc_feature (71): n=t or c
agagacgtagcagcccacccctgttatctttctcaagccaacccactgaaagtctactttgcctcccctgntcaaaacaacaggcatgcatgcacaagaat

SEQ ID NO: 57290 - DNA, 101 bp, rice(Oryza sativa)
  misc_feature (71): n=a or g
tgaacctgtggttacactgccagagaataaccgcaacatccagtcctacatcaatcttgcattcgatgtcnatgacgattctgcctctgtcagcagcaacg

SEQ ID NO: 57291 - DNA, 101 bp, rice(Oryza sativa)
  misc_feature (71): n=a or g
gatgaagcccccatgactcatagaagatgctttgaagctttagatctaaccttacgtgatttgctttctgnacagacaccttctaacagtatagttccatt

SEQ ID NO: 57292 - DNA, 101 bp, rice(Oryza sativa)
  misc_feature (71): n=a or g
cataacaccgtccccatttggcttaggtggtgattttacatttctagccattttcaggagttggtacatcngggcatgtacatcaattcttattttctaac

SEQ ID NO: 57293 - DNA, 101 bp, rice(Oryza sativa)
  misc_feature (71): n=a or c
tattaatgaaacagatcagtattgttgtgccttccgattaggccgggataattcagaattaatagaatttnttttcaaaaagaaaaggatcaaacgggttt

SEQ ID NO: 57294 - DNA, 101 bp, rice(Oryza sativa)
  misc_feature (71): n=t or g
gaacgaattacaaacgcgttttgttttgttatagttgttggacgatggcctgaccggaatcaaaatcaagngtctttttctcaaacttttgtgtgtgtttt

SEQ ID NO: 57295 - DNA, 101 bp, rice(Oryza sativa)
  misc_feature (71): n=t or c
tgtaatgttcagaccttagtgttccagctagtcagtcacggactcacacattatgactatgagtttcaacnataccgaacgttttgagatatatacttcct

SEQ ID NO: 57296 - DNA, 101 bp, rice(Oryza sativa)
  misc_feature (71): n=t or c
atggtgggcagtcagaccagagcgaattcaccgatcgctatctaattttttattcctctggaaggtttggnttttgggtactacaacaattcacacccctc

SEQ ID NO: 57297 - DNA, 101 bp, rice(Oryza sativa)
  misc_feature (71): n=a or c
tacgctgcaatgacgcaaggaagcagactaacaattattttttgaaaaagaaactagtatgttatactacnttcattccaggttataagacatttctagca

SEQ ID NO: 57298 - DNA, 101 bp, rice(Oryza sativa)
  misc_feature (71): n=a or g
atattgtcagaagtgaaggaacaatttggccactgctaacaatgcctggttcctcttcaatcataagctcntcaagttatacagtgtgcaatgggaatgaa

SEQ ID NO: 57299 - DNA, 101 bp, rice(Oryza sativa)
  misc_feature (71): n=a or g
tcacaagtaagaaatgcatctccattctgatttttatacaatattttttttaccctgcctatgaaaaactnattttttatttatagtaattaataagtctt

SEQ ID NO: 57300 - DNA, 101 bp, rice(Oryza sativa)
  misc_feature (71): n=a or g
ctagcgtcttgtgtgatgaatctaggtattatcactagatgtcgcgagtatcttatgtgatactagcaagntatcatccctagtatggattaataaataca

SEQ ID NO: 57301 - DNA, 101 bp, rice(Oryza sativa)
  misc_feature (71): n=a or g
ggacgatagggctggccgaggaagcaccaacaagggctatatatgcacactagaccggagggagagagagnaaggggagagttgtgagactgactagtggg

SEQ ID NO: 57302 - DNA, 101 bp, rice(Oryza sativa)
  misc_feature (71): n=a or g
aatgggcttggtgctggatggaacatcatttacatatgttggacttgagatagagctggcatccagagaanttgttatgggcacagagctaggcaatgccg

SEQ ID NO: 57303 - DNA, 101 bp, rice(Oryza sativa)
  misc_feature (71): n=a or g
gagaagacacccttctgtttgtctacgaaagaaaaaaagaaagaacatgttgttcacctcttgcaggcgantaccatccattgtgttgaatattcttatca

SEQ ID NO: 57304 - DNA, 101 bp, rice(Oryza sativa)
  misc_feature (71): n=t or c
agaacctgacgacatcgtagttaccctcaaaattgtactgccgatcaaagcaaaaacattgttatagtatnactagtatttatccatggttgttattgtat

SEQ ID NO: 57305 - DNA, 101 bp, rice(Oryza sativa)
  misc_feature (71): n=t or g
aaaccgaagcgcaaatgaatgggagatgcttttggaatacgctgcagagccaacagatcatggagatattnacagcatattccacctgtgctatgcggttt

SEQ ID NO: 57306 - DNA, 101 bp, rice(Oryza sativa)
  misc_feature (71): n=a or g
agctactggatacatccagttgtgcccatctattgcacaagctatgcacaaatgtcccctaaacctgcttntcaagaaagtgctatctactgcaagatatg

SEQ ID NO: 57307 - DNA, 101 bp, rice(Oryza sativa)
  misc_feature (71): n=a or g
cgaagaaaagccaagacctagcaaagaggcccaacctaaagccatgactacctttcagtgtgcatgtgagnccatttagcacgggaaaaatcgtatcagta

SEQ ID NO: 57308 - DNA, 101 bp, rice(Oryza sativa)
  misc_feature (71): n=a or g
atagagatgtcaaatcgagcaacatcctgatggatgctgagctagtacccaagctcacagattttgggatngggaagatcattgatgatgatgatgcagac

SEQ ID NO: 57309 - DNA, 101 bp, rice(Oryza sativa)
  misc_feature (71): n=t or c
catgatccaagtgctttaagaaaatatttttcatgttgcgtgcgaacacaatctcgtgtcaatgtctaganaccaggtttttttttcaaaacaatctattt

SEQ ID NO: 57310 - DNA, 101 bp, rice(Oryza sativa)
  misc_feature (71): n=t or c
tacttgtctttagctggaaacagtgagctttgtgggggaatatctcatcttaacttacctccatgctccangcatgctgttagaaagagaagcaaagggtg

SEQ ID NO: 57311 - DNA, 101 bp, rice(Oryza sativa)
  misc_feature (71): n=a or g
tactcactcaccttgggatccagtttgccccatggttggctgctggtttggggataagagctccacctacnagatccccattgtagtaggtcgcctcgcac

SEQ ID NO: 57312 - DNA, 101 bp, rice(Oryza sativa)
  misc_feature (71): n=t or g
ccagataggataaacacctaaagtggcactagagaaaatgaggtgtcacacaaatgcagaatcgtgctatnagcaccggttcaaaaaccggctagcactac

SEQ ID NO: 57313 - DNA, 101 bp, rice(Oryza sativa)
  misc_feature (71): n=a or g
ttttaacagttttgtaagtttaaggatctgtcgtaccggttttgcaattaaaggacgaaaatcaaactggncgacaaatagacaaatagaaagactcaaag

SEQ ID NO: 57314 - DNA, 101 bp, rice(Oryza sativa)
  misc_feature (71): n=t or c
cgcctgcaaaaatgtcaaaaaaaaaaatcttcaacttatctctcctacacccccatccttatcttctcctncatccctccccaccactcatttccccatct

SEQ ID NO: 57315 - DNA, 101 bp, rice(Oryza sativa)
  misc_feature (71): n=t or c
caatgaaaatgacattctagcgaatacccaagacttgtcagtggcatttaagccaatccctcagcgaaacnagtttttaagggcgacagacatgtaaattt

SEQ ID NO: 57316 - DNA, 101 bp, rice(Oryza sativa)
  misc_feature (71): n=a or g
tataattgtattataattacatatgtacctagcatatactgtaacttgtataaataggatgagatcacagnatcgatccctccttgtgcgttgcttttctc

SEQ ID NO: 57317 - DNA, 101 bp, rice(Oryza sativa)
  misc_feature (71): n=t or c
tgccaccggggccagctaccatgccggtgttgggtaacatgcaccagatgctgatgaacaagccggtgttnaggtggatccaccgccttctcgacgagatg

SEQ ID NO: 57318 - DNA, 101 bp, rice(Oryza sativa)
  misc_feature (71): n=t or g
ataaattttatttgcagattcaatcatgaatagaaattttgttaggaataaaaagtttactcttaatggcntggataaatcttaggcgttcatttttagat

SEQ ID NO: 57319 - DNA, 101 bp, rice(Oryza sativa)
  misc_feature (71): n=t or c
aaatgtagaaaagtaaaaagagtagcgatgcgacgaagtttattgatatgtgaatatagtttacaatgatnctgagtgtacatatttatacccatgggtag

SEQ ID NO: 57320 - DNA, 101 bp, rice(Oryza sativa)
  misc_feature (71): n=a or g
aaatgtttaattttgattattttcctggtactgaagtactgtctaatttgacctctttgaagtacttgacntttgaattttttctaactttgccatgaaga

SEQ ID NO: 57321 - DNA, 101 bp, rice(Oryza sativa)
  misc_feature (71): n=a or c
agctgatgaatcgcactggggaaacgaaaatcccattctctgcaatttacaagtacattgataacagcctnaaaatccatctctatttgcaccatccaaag

SEQ ID NO: 57322 - DNA, 101 bp, rice(Oryza sativa)
  misc_feature (71): n=a or g
agcggtttcgacgatgattttgtcgtatgtggggttcattttacctcaagcgatatgttattacaataatnaaaaaagagttgttggccccacatgtcaat

SEQ ID NO: 57323 - DNA, 101 bp, rice(Oryza sativa)
  misc_feature (71): n=a or g
tgaatttgtattatatgttatgataaaaagaacacttttacaatgctcctgatatcaatcagtcccacttngatcccaacaagagggaaacaagaaaatgt

SEQ ID NO: 57324 - DNA, 101 bp, rice(Oryza sativa)
  misc_feature (71): n=t or g
agaggagtcaaggcgacgcttgagctcggtgacgccgaccgtcgcccttcttctctccagtatatgttgtnccctcctcatcgctaccaccatctactgcg

SEQ ID NO: 57325 - DNA, 101 bp, rice(Oryza sativa)
  misc_feature (71): n=t or c
agcagcagtaggccagagaaacggtgttggtggtgatgaagcaagggtgacgagactcaggggttcccaanggcgcacagggaagagaaacagcttcgccc

SEQ ID NO: 57326 - DNA, 101 bp, rice(Oryza sativa)
  misc_feature (71): n=t or c
caaacaataaataatatatgatgatcaaggagaacacacataccagtggcaacaacaagaagtaggagganggcgattgctgggaagaatttacgcattgt

SEQ ID NO: 57327 - DNA, 101 bp, rice(Oryza sativa)
  misc_feature (71): n=t or c
ccttcctctaccataccagagtgattgcaacccattaagactcccaaaaatgtcgaatcatctggcttgangccattggaacgcatcttgctgaatacctc

SEQ ID NO: 57328 - DNA, 101 bp, rice(Oryza sativa)
  misc_feature (71): n=t or c
aggggaaatgcagagcagtcaccgctccgacgaggggtcttaccaagaaagctcaagacagtatatatctngggtggacggattcccgcgggagggggagg

SEQ ID NO: 57329 - DNA, 101 bp, rice(Oryza sativa)
  misc_feature (71): n=a or g
actcaacttggttgaatttagtagaacacacactttattgctgtaccccaaatcttcaaaaactattgacncaaaatccgtgctcggccgatggtaccaga

SEQ ID NO: 57330 - DNA, 101 bp, rice(Oryza sativa)
  misc_feature (71): n=t or g
aaggtgtcatatgtctttatgttgtcattttatggtctcttaaaagattatctaagttcaacatcaaatcntccttaggtatagctaaaaaagggtatcat

SEQ ID NO: 57331 - DNA, 101 bp, rice(Oryza sativa)
  misc_feature (71): n=t or g
agtcaacatcaggaagcaattcccagtctacaagccaacatcacaaatttacatccagttttgtagaaatnaaataaaaccgatctcgtgaacaacaaagc

SEQ ID NO: 57332 - DNA, 101 bp, rice(Oryza sativa)
  misc_feature (71): n=t or g
taccagtggacacatcaagacacttgaatcccttatgaatattactatatccaagagaaacacactgtttngagcgaaattggagttttcgagtgttaaaa

SEQ ID NO: 57333 - DNA, 101 bp, rice(Oryza sativa)
  misc_feature (71): n=a or g
ttttgtagctgaccagcttcttgattgtgcaactgcaagcgacacaacacaaatcaagctcttgtttggancaaagggggctgtccacatcaaaggcaggt

SEQ ID NO: 57334 - DNA, 101 bp, rice(Oryza sativa)
  misc_feature (71): n=t or c
ctgatgtgttgggtggaagacggtggtcaaactacttgcaattaaccagcaacagtatcaaggagttcagncatttaagtcttcctttaaacgaaaaacaa

SEQ ID NO: 57335 - DNA, 101 bp, rice(Oryza sativa)
  misc_feature (71): n=a or g
tcttctctttccgttttcccaaaaatcaaactcgaggtaaaaaagattggggaagatagtcgtcatcgtcngcaactattaggttaaatccagcgaaataa

SEQ ID NO: 57336 - DNA, 101 bp, rice(Oryza sativa)
  misc_feature (71): n=a or c
ataagtactagtacgctgagtttccgggcgaatcattacttggttaattagcacattgcctgtcgcttggngattaatccacgcgacattcggatagcctc

SEQ ID NO: 57337 - DNA, 101 bp, rice(Oryza sativa)
  misc_feature (71): n=t or g
tcacgtatgatattcctcatcactcgcatcccatacagcttgaagccatcctgatgcatgcagcgcacatnaaatttgtacaaaacaaatatgcacgcttt

SEQ ID NO: 57338 - DNA, 101 bp, rice(Oryza sativa)
  misc_feature (71): n=t or c
tctacctcccaatgaaaattttaaaaacatttacgtgttgtttggtgataaatctgttttatgatcaaagnaaatttctttgtattatataatcccttatt

SEQ ID NO: 57339 - DNA, 101 bp, rice(Oryza sativa)
  misc_feature (71): n=t or c
gaagttcactctgtattttcatgagtcccaaatcaaagcgggatttaatgttatcctgtgtctttccttcnagatttaacaaggtacccacaatactatca

SEQ ID NO: 57340 - DNA, 101 bp, rice(Oryza sativa)
  misc_feature (71): n=t or c
gaagtaacatgatatttgcaccattttacagtccttcaaggggagaaatctaggtgttgacaacacgccancgccaggtgacagcgaatcgacacaatgtg

SEQ ID NO: 57341 - DNA, 101 bp, rice(Oryza sativa)
  misc_feature (71): n=t or g
agtatcgaaactacagaacggatagtaataacccattccaatggtttggggtagtttcttaaattgcattnactccagatggaccaggaaggcaccaatac

SEQ ID NO: 57342 - DNA, 101 bp, rice(Oryza sativa)
  misc_feature (71): n=a or c
tgaggtacatatccaattcagtatcaacttgctcagttaattgtttagtgatgtgttgaacccaatcagcnataggatcattttctgagatagccatcaca

SEQ ID NO: 57343 - DNA, 101 bp, rice(Oryza sativa)
  misc_feature (71): n=t or g
tcagtactgtagatgaatatgtgttttgcttccaatcgagattagtgtttgttggttctcttcaattatgncgatgttccagtctatcagcttagggataa

SEQ ID NO: 57344 - DNA, 101 bp, rice(Oryza sativa)
  misc_feature (71): n=a or g
tgggagttagtatcaacctgcccatgtgaaccatcacagtaccacctaattgacctgcttaatttgcactncaaaattcattgttgagcttcatacatatt

SEQ ID NO: 57345 - DNA, 101 bp, rice(Oryza sativa)
  misc_feature (71): n=t or c
actttgagacacctttagaacgtctctttagcatcaaacctgattactctgcccttcgcacctttggttgngcttgctggccgaatcttcgtccttatcaa

SEQ ID NO: 57346 - DNA, 101 bp, rice(Oryza sativa)
  misc_feature (71): n=a or g
gaaggaatggtgctcaagccctactctcaccgctattactgcaggtagctgccatctcatgcctattgagngttatggtaaagatgctatcatttttgcgc

SEQ ID NO: 57347 - DNA, 101 bp, rice(Oryza sativa)
  misc_feature (71): n=t or c
ctaagaagtagctctatgatccagtgttcatcgatcctccatgtgagattcgcgtgagagttcatcgtctntgcttgctcggataatcaatcaccaatcca

SEQ ID NO: 57348 - DNA, 101 bp, rice(Oryza sativa)
  misc_feature (71): n=a or c
acatcctctggtgtcatgccatctaccgattgttggattagtcctgagcccatccataaatacactaattntttctttgtgaattcatagtctttatgaaa

SEQ ID NO: 57349 - DNA, 101 bp, rice(Oryza sativa)
  misc_feature (71): n=t or c
caatcctttttttttttgtctgaatatagtgcccagtttcatcattcatctttatcgccacgcttcctccngacactatttgctctatccatttacaccat

SEQ ID NO: 57350 - DNA, 101 bp, rice(Oryza sativa)
  misc_feature (71): n=a or g
ccgacctcccaagaatgagatatcgacacatacaacatgcaagtagtactacttttgagcagttagtaacnctgacgatttagcaaatgtcattgtctaaa

SEQ ID NO: 57351 - DNA, 101 bp, rice(Oryza sativa)
  misc_feature (71): n=a or g
taataatttagaatcaaatgagacctattctagtactacgaggttcgtagtagtatgatacatgcaatccnattctagcataccatattgtgggatggagg

SEQ ID NO: 57352 - DNA, 101 bp, rice(Oryza sativa)
  misc_feature (71): n=a or c
agggtcagcaagctcccacctcagatcaaggagctgcacatcctggggacattggacgtcagccacaccancataagtgagatcccatcagaagtgtggga

SEQ ID NO: 57353 - DNA, 101 bp, rice(Oryza sativa)
  misc_feature (71): n=t or c
agattttctttttaataccaccaatgcagattatagctgggcaacattctgatttctataaaccggctgtnatagcttctatctaaataggtactttagca

SEQ ID NO: 57354 - DNA, 101 bp, rice(Oryza sativa)
  misc_feature (71): n=t or c
tttccacaccatattgcaacttgtttggtggcgtacctatactatactctctatcaaaaaagtgttaaacntattacttttatcatcagtatcagaaaaaa

SEQ ID NO: 57355 - DNA, 101 bp, rice(Oryza sativa)
  misc_feature (71): n=a or g
cgtttcgaacatgtctcaaaaatttgataagtgtcaacctgcagattggtgggttgacactagagcaactnttcatgtgtgttttgatcgatctttgttct

SEQ ID NO: 57356 - DNA, 101 bp, rice(Oryza sativa)
  misc_feature (71): n=t or c
agagaatgatagagttagagagtgagaactgcttggagagtaacgagagagagagagggacacgacactgngacagacaaaatgggagagagaacgagaga

SEQ ID NO: 57357 - DNA, 101 bp, rice(Oryza sativa)
  misc_feature (71): n=a or g
taaatttttctccttttataataagattcaaggataatatctatttgtacctcttactagaaaaaaaaatncacgtgcattgcaacgggtaaaggtatttt

SEQ ID NO: 57358 - DNA, 101 bp, rice(Oryza sativa)
  misc_feature (71): n=t or g
tcccagacgcaagtaaatatgcagacatacaagaaaggaaaaaaaaaaggggaagaataggaaaatcatangattctcataggaatttaactacaaaactt

SEQ ID NO: 57359 - DNA, 101 bp, rice(Oryza sativa)
  misc_feature (71): n=t or c
tcgagatgatcccaagaagaattacacggcaacgacagcagaagccagcttagtacaacaaagcagctacnatctccaccttcgcagcagcggaaaccgta

SEQ ID NO: 57360 - DNA, 101 bp, rice(Oryza sativa)
  misc_feature (71): n=t or c
atcttagccactttgaaccgacctcgagtaacgctccaaataatgatggagggcaccacctgtgtagttanctctaaatgattgtcattggtttggttgtt

SEQ ID NO: 57361 - DNA, 101 bp, rice(Oryza sativa)
  misc_feature (71): n=a or c
acagcaggaactccaggcttccacaagatagtgctgaaactcaagctctagcagtagcagcaatcctccantgcaaagtagaaaaatttcccccaggtgta

SEQ ID NO: 57362 - DNA, 101 bp, rice(Oryza sativa)
  misc_feature (71): n=a or g
tatattgagatatagggagaatcccagtgatctaatctatccttagtgccttagtggtgtttagatgtagnggtgtaaagttttggcgtgtcacatcggat

SEQ ID NO: 57363 - DNA, 101 bp, rice(Oryza sativa)
  misc_feature (71): n=t or c
aacacatccaaatcaaacaaatcagatttcagtcaaaccaatcgcatcagcaaacacacaacacataatcncccacgagttcaaactcgatccccacacac

SEQ ID NO: 57364 - DNA, 101 bp, rice(Oryza sativa)
  misc_feature (71): n=t or g
cgttattgttaacgaccaaatttggtaaatcatgaactaggttcaacatcagaatcgaagtggattcggcngagaatcgtgttcaaagaacagagtgcgca

SEQ ID NO: 57365 - DNA, 101 bp, rice(Oryza sativa)
  misc_feature (71): n=a or c
ccgggatccatcgtcgtagttgtcgcttaaggccgctgccatcgtggtcaaagtcccccgaggcccggctntggcagatcccgcttacccaaggcctggcg

SEQ ID NO: 57366 - DNA, 101 bp, rice(Oryza sativa)
  misc_feature (71): n=a or g
gattattgtgagtctgagctccttcaagtggaatatgtaagctgtagagtagtaatgcttgggatgcatantttgtaaataatagctactagtaccttttc

SEQ ID NO: 57367 - DNA, 101 bp, rice(Oryza sativa)
  misc_feature (71): n=a or c
caagccactacaccaaaccctgctaccatgcctgccgctgtcaaccgggctgatgtaataagtctcccaancacaccaagccccgatgtcatgcccacaat

SEQ ID NO: 57368 - DNA, 101 bp, rice(Oryza sativa)
  misc_feature (71): n=a or c
taagatacaagtaaggcacgaaacttaaattgcaaactggtgttatggcaaatatttatttgttgacatgngaagtacctgagggatttcaatggttactt

SEQ ID NO: 57369 - DNA, 101 bp, rice(Oryza sativa)
  misc_feature (71): n=t or g
tttcaaaatgttcggaaatctagtcatgttacaagatgacaaacccaagtaccctatgttggggaaggatntgagtgaagaattgctttctccatttatta

SEQ ID NO: 57370 - DNA, 101 bp, rice(Oryza sativa)
  misc_feature (71): n=a or g
atctaacagactcatcctgagcttccagtgcttgtagggattgtaggcttgtcaagttctcaaggcccctngggatgcttacaccagtgcaccacctgaaa

SEQ ID NO: 57371 - DNA, 101 bp, rice(Oryza sativa)
  misc_feature (71): n=a or g
tttggagttgaagaatggaactgagccttggtattgattgcggagaatataagtgcggttagaaatacacnctaccgataattttaagcacattattactt

SEQ ID NO: 57372 - DNA, 101 bp, rice(Oryza sativa)
  misc_feature (71): n=a or g
cacaacatcttccaacaaatgaaatctgaacatggaagacttgaaacaaagcacaacccaccaaaaaaagnatggggtcctccagatcgatccaaagaaac

SEQ ID NO: 57373 - DNA, 101 bp, rice(Oryza sativa)
  misc_feature (71): n=t or c
catcgctctctttctttcttctctcttaatttcttctcatcttctcctcccctcagctctctcgcaccctnccctcgcctctctcgtgcggtggtaggagg

SEQ ID NO: 57374 - DNA, 101 bp, rice(Oryza sativa)
  misc_feature (71): n=a or g
ccaccgccttctccagtctctgacaggtgggcccttagcgattgagggaggtttggtcccactttaggtcngttttgactattaggtgggccctccaatct

SEQ ID NO: 57375 - DNA, 101 bp, rice(Oryza sativa)
  misc_feature (71): n=t or c
tggtacatgtgttcagacagctaatggcacatcctgtttagttactcaccagggcactctttccacttcanaactcactgtaccaaatgtttctcttgtgc

SEQ ID NO: 57376 - DNA, 101 bp, rice(Oryza sativa)
  misc_feature (71): n=a or g
aggtaaaactgtctcccagctatctttatatattgagattggacatggcaaggcccgtttgtttggcggcnagtaggagcaaggaggcaaggctatggcat

SEQ ID NO: 57377 - DNA, 101 bp, rice(Oryza sativa)
  misc_feature (71): n=t or g
aacaaggtaaagatgcaaatcattccttaaatctgataagccaaaacaaaacagacaaacaatagataganagatattcaagtcggagagaatgagagaaa

SEQ ID NO: 57378 - DNA, 101 bp, rice(Oryza sativa)
  misc_feature (71): n=t or c
ctcttctttcatcaaccagcagcctgttagcaattcttcgaagcccgttgtcagatttatatccccggagnggtcatcccactgcatctgccgatctgcaa

SEQ ID NO: 57379 - DNA, 101 bp, rice(Oryza sativa)
  misc_feature (71): n=a or g
aatctctttacatggtctagccagatctcaatagagtagatgatgtgaatcaaggtttatatacactaatngagaaaccatctttgataggttgccaaaaa

SEQ ID NO: 57380 - DNA, 101 bp, rice(Oryza sativa)
  misc_feature (71): n=a or g
ggcatcatcatccatccccctgcccgtctatccggcaaaagagcgaaaattttcggtagcatcaggtcatnagcatctgaaagtctgaaaaagaaaaactg

SEQ ID NO: 57381 - DNA, 101 bp, rice(Oryza sativa)
  misc_feature (71): n=a or g
gttttcggtggggttgcgcttcatgtcttcatactttaggattaacacgttatctggcttcaccttgctcncgttccagtacccaaggatgtgatcccaaa

SEQ ID NO: 57382 - DNA, 101 bp, rice(Oryza sativa)
  misc_feature (71): n=a or c
aactaatgcttcgttttgcatctcatgacttggagggcatccgcttctccatagaaaactacctggtgccncaagtcgctgagctgaacaaggctatgcgc

SEQ ID NO: 57383 - DNA, 101 bp, rice(Oryza sativa)
  misc_feature (71): n=a or g
caatttaaccatttaaattatataactggacctctagccaaacacgttcgttcctttgtgcttattattgnggaagggaggagcaacttgctcgtttacca

SEQ ID NO: 57384 - DNA, 101 bp, rice(Oryza sativa)
  misc_feature (71): n=a or c
tcgttgggttcacgactctacccacccgctagagaactctagttcaagtcctggtgtcgataattatgacngtgtgcatctgtgattagtgtagatgctgg

SEQ ID NO: 57385 - DNA, 101 bp, rice(Oryza sativa)
  misc_feature (71): n=t or c
tctcccttatctctctcccctttacttcactcggtggtggcaaggagaggatccaggcagcgaagcatggngtccaggcgttgtttctctagccgcgtcgc

SEQ ID NO: 57386 - DNA, 101 bp, rice(Oryza sativa)
  misc_feature (71): n=t or g
gtgctcgatggatcccactttgtcaagtttaccgtcgtccagaagttgacaccgatatggagtccaaaganaaacaaagaacccttctctgacgagttgag

SEQ ID NO: 57387 - DNA, 101 bp, rice(Oryza sativa)
  misc_feature (71): n=t or c
ttagtgaacgggttcattatctaaatactaaaataaaaacaaatcaagtaacggagaaatggtggcgcagncacttcagaagccaggccaacgatgcgcac

SEQ ID NO: 57388 - DNA, 101 bp, rice(Oryza sativa)
  misc_feature (71): n=a or g
ataagcggaatctcaccctaattggcatggcacccgtcgtggtgccaacgagatgcagagaggcggatacntaggggttgtttggatggtgatcatacttt

SEQ ID NO: 57389 - DNA, 101 bp, rice(Oryza sativa)
  misc_feature (71): n=a or g
ctgatccttgctcataattaatttcttgcaaatcatatgtagcctgtagggtagggggcagcaggcaaacncatatataagaatagcttaatcgctaggtt

SEQ ID NO: 57390 - DNA, 101 bp, rice(Oryza sativa)
  misc_feature (71): n=a or c
aacatttgaaacatgcaatatatttgtagcactttatattattgagaaacattgttaatcatgtatgaaanattaggttctaactgttgaaacatcataaa

SEQ ID NO: 57391 - DNA, 101 bp, rice(Oryza sativa)
  misc_feature (71): n=t or c
cccgctgtaaaaattggttgttgcccgatgaaacaaaagtccctcaaacaagagaatccatagcagccacngattatgagactgtctctgtaccctggtac

SEQ ID NO: 57392 - DNA, 101 bp, rice(Oryza sativa)
  misc_feature (71): n=a or g
aagaaaaatcccaatgtaaatcctggccacagaagtataataatcatgtaaattgtttcctattccctccntaaaaaaacctacctagacggttgattttt

SEQ ID NO: 57393 - DNA, 101 bp, rice(Oryza sativa)
  misc_feature (71): n=a or g
tagggatgtcaatgttactcttgatggaaccactcacttcttgcctgcttggtctgttagcatcttaccgnattgcaagactgttgcctttaatagcgcaa

SEQ ID NO: 57394 - DNA, 101 bp, rice(Oryza sativa)
  misc_feature (71): n=t or g
cccagtccagagcaagcaccttgactgatcggacatggtgtcggctttggtcaagttgccataagcataancgtaggccatgcatgagcagttgtggctgc

SEQ ID NO: 57395 - DNA, 101 bp, rice(Oryza sativa)
  misc_feature (71): n=t or c
gtttggtgcgacatgtagatcagcagagaaggtgagaaaaaatgtacaactctgtcatcgttcatggttgntgatcacgatgtcgatacacagaatacaca

SEQ ID NO: 57396 - DNA, 101 bp, rice(Oryza sativa)
  misc_feature (71): n=t or c
gtgttcttgcaccattgtagaagggacaaggtggcctataaataagcagattcttgtgtagtttgtgtgcngacgatggaaggcagctgatagatagctag

SEQ ID NO: 57397 - DNA, 101 bp, rice(Oryza sativa)
  misc_feature (71): n=t or c
gggaagttcacatgcttcatccaggagaatgaagaaggaacctggaaatgggcatctctccctgaacaagnaggtaacatttgccttgttgattcatctaa

SEQ ID NO: 57398 - DNA, 101 bp, rice(Oryza sativa)
  misc_feature (71): n=t or g
tgggcgtgattccgaccgaattgggaatcggacgacctcacctcgcagccgaatcgaactgggggttgcangttgctgccgcggtggagaattccgcctct

SEQ ID NO: 57399 - DNA, 101 bp, rice(Oryza sativa)
  misc_feature (71): n=t or c
accagctccaggcgtggatgaaccaggtcaaggacctcgccaaccattcccagtactgcgtcgaccagtanttgcggtgcctcggcaccaccagccaccgc

SEQ ID NO: 57400 - DNA, 101 bp, rice(Oryza sativa)
  misc_feature (71): n=t or c
cacattactacagccattactcgctatgagataatgctgacatgtctgtgcgctcatttcagatcttgttngtgtcaagtaaatgaagtatatatttatct

SEQ ID NO: 57401 - DNA, 101 bp, rice(Oryza sativa)
  misc_feature (71): n=t or c
gtgggtagagacaataactactaccgggccactgtgctactgccggtaacaagagaataaacaatattttntgtagatatgggaatctttttgtactagca

SEQ ID NO: 57402 - DNA, 101 bp, rice(Oryza sativa)
  misc_feature (71): n=t or c
tgtattatttacaaattatttttcgtttgcaaatataccgtttataagccaaacgatggggcattaacttnggggctttaacctatttgccactcttacga

SEQ ID NO: 57403 - DNA, 101 bp, rice(Oryza sativa)
  misc_feature (71): n=t or g
ctcaaaagatgctgtggatgaaatgatgttgaatggtgtcatgcactttgagaagactgttaagtgcccanactacggaattggcacaatccttgctccag

SEQ ID NO: 57404 - DNA, 101 bp, rice(Oryza sativa)
  misc_feature (71): n=t or c
ctaagcccctatatatctgaaaaaaatataacacagttctaggcctttaatagctttttccaaaatctccngaggttctctaaatggtccaaatttattta

SEQ ID NO: 57405 - DNA, 101 bp, rice(Oryza sativa)
  misc_feature (71): n=t or c
caataataggtggtgcaactggaggttttacactttctcgcggaactcctattgaagaaatggaaaaacanaagcatacacaacatgattattttgattga

SEQ ID NO: 57406 - DNA, 101 bp, rice(Oryza sativa)
  misc_feature (71): n=t or c
ttggttgtatctcaaattgttctcaaatttaattaacgtggggaatggaactgttgtgtgattaaatggtnaatttaattacagatttgacaagatggaat

SEQ ID NO: 57407 - DNA, 101 bp, rice(Oryza sativa)
  misc_feature (71): n=a or g
tgctaattgtatatacacattaattgtgcttttactttgggtagtaagtttctttgtgcgctgatggagangtctagacggaatatccatcataatatatt

SEQ ID NO: 57408 - DNA, 101 bp, rice(Oryza sativa)
  misc_feature (71): n=t or c
taaaaaaattctatagttttgttttccttaagaataagaatgtctttaaaaggtctaatcgggaaagctanttgtttacttaggtagacatttgtttactt

SEQ ID NO: 57409 - DNA, 101 bp, rice(Oryza sativa)
  misc_feature (71): n=a or g
taaaacgtaactttgtttggaaaagtttttagggctgtattggacatcaagggctatgaaccttttccccnttacattacacgtaaaacagagtgatgaat

SEQ ID NO: 57410 - DNA, 101 bp, rice(Oryza sativa)
  misc_feature (71): n=a or c
atatacaactctcctaacttgataattttggcataagagaactcatgccaagaaacagaggtagctacccngtcctaatagcagcaactactactaaacat

SEQ ID NO: 57411 - DNA, 101 bp, rice(Oryza sativa)
  misc_feature (71): n=a or g
cgtacctccgcggtaagctcagtaatcgacggtaagtcgaacctgtcgctttctcgattcgggagaattgnttattaatagtatatatcgcgtgtgcttgt

SEQ ID NO: 57412 - DNA, 101 bp, rice(Oryza sativa)
  misc_feature (71): n=t or c
aatcattaatttgcagtcttttactaaatgcttactctgttgcggttgttactctatgtgtcactataaanaagtaccgcaaccgtcctaaaaaatgctat

SEQ ID NO: 57413 - DNA, 101 bp, rice(Oryza sativa)
  misc_feature (71): n=t or c
tagtactacctacaacaacaagtaggtgtaccgggctaccagcgacctagccataggataagagcaggtanaaaagcaggctataagccaactataaacat

SEQ ID NO: 57414 - DNA, 101 bp, rice(Oryza sativa)
  misc_feature (71): n=t or c
cagcaaaacccctcatattaatccatccataaaccctagaaatcgcggcgccgcaaaccccctctcgactngagcgagcgagagatggaggaggatcaagg

SEQ ID NO: 57415 - DNA, 101 bp, rice(Oryza sativa)
  misc_feature (71): n=a or g
cataatgccctaagacaacattcaccctagcttactgaactacagcttgtattagtattaccatgctaganatcagttccgtaaaataaacggcatggtag

SEQ ID NO: 57416 - DNA, 101 bp, rice(Oryza sativa)
  misc_feature (71): n=t or g
tattatatttagtaaaatgctactcgacaccaacggcaaatatatcttccattttctattattttccttgntaaattgtttgtctgctcatttattattgc

SEQ ID NO: 57417 - DNA, 101 bp, rice(Oryza sativa)
  misc_feature (71): n=t or c
aaattctccctgggaaaatatgcaatctcttttagaaagaacggtccgaatttgaacaggaacaccctttntcctttgagcataatctattggtgacttga

SEQ ID NO: 57418 - DNA, 101 bp, rice(Oryza sativa)
  misc_feature (71): n=a or g
caccagttacaaattgggttaagagcatgcgacattctctcctctcgtttgactctttttggacggagggngtaaatggttattaaacaaaatttgaaaag

SEQ ID NO: 57419 - DNA, 101 bp, rice(Oryza sativa)
  misc_feature (71): n=t or c
gctccgaggtcaatgaaagtgatgaagaagtgttcgatgatccctttgccgacgaagctagtagtggtgtngttcaggagaaggaaggtgtgggacatggt

SEQ ID NO: 57420 - DNA, 101 bp, rice(Oryza sativa)
  misc_feature (71): n=a or g
aatggtttagcatcaaagacacgttgatctaatggctgagatgattctgatgacgaggctagctgagaccnccgggccggcacgggcccgacccaagtcag

SEQ ID NO: 57421 - DNA, 101 bp, rice(Oryza sativa)
  misc_feature (71): n=t or c
aagtagcagtaagatcgcaattgctactttttaatggtataccaaatttgtcatattgtttctatttatcngagtgttaatgttgctttctcatgggtggt

SEQ ID NO: 57422 - DNA, 101 bp, rice(Oryza sativa)
  misc_feature (71): n=a or g
caataatcatcgatcatcaacccaacaagacaacatggttgctgtatcttgagacaccaatctgaataatngacaggacatcgcgccagctcttcggaagt

SEQ ID NO: 57423 - DNA, 101 bp, rice(Oryza sativa)
  misc_feature (71): n=a or g
atgatgttgcaactgatgaagtgccggatatagtgaacaatgcaacagctagagatgtcatgtttgtcccntctccattaggcggagataccatatattta

SEQ ID NO: 57424 - DNA, 101 bp, rice(Oryza sativa)
  misc_feature (71): n=t or c
gctgcagctgcactgctgcaaattcaatgggccgtggacaggtgttgccgaggctcgctgtctgatccggngatgtgggcccggacacctcatggccgtcg

SEQ ID NO: 57425 - DNA, 101 bp, rice(Oryza sativa)
  misc_feature (71): n=a or g
gccatctgacattcgccggaaggcgcccccctacacgtacagactacagtgcatcccacgcccgagtgcgnaccagccgtgccgctgtcacgtgtgcgcgc

SEQ ID NO: 57426 - DNA, 101 bp, rice(Oryza sativa)
  misc_feature (71): n=a or g
ataggtggataatcccaaatgtcgtggccccaaagctttgcttaagaatgcgattgggtgattattttgcntaagtacagcacccatccctttgtcagaag

SEQ ID NO: 57427 - DNA, 101 bp, rice(Oryza sativa)
  misc_feature (71): n=t or c
ggtacaggggtagttcctgagataagggagtagcatcaatctcccgttgtggtgcaagtgcaacactgtgnttgacactgtacagtgtggattattttcca

SEQ ID NO: 57428 - DNA, 101 bp, rice(Oryza sativa)
  misc_feature (71): n=a or c
tctctgtcatcaaagttcagaattgagagttcacatatcctcagtggtcagagttcagagttgagacgacngccgagccttgcatattgagcagacaagct

SEQ ID NO: 57429 - DNA, 101 bp, rice(Oryza sativa)
  misc_feature (71): n=a or g
gaaccgctccttgcccccgtgaaagagaagccatcctgtacaaccaccatcacaccttcacaaaaggctcnctattcattagtcaactaatatttctggaa

SEQ ID NO: 57430 - DNA, 101 bp, rice(Oryza sativa)
  misc_feature (71): n=a or g
gaccacggcctgaaaatttgtactgtcttctgttgtttaggggggacatccaagtatgctagcaactccantgtgtctgcagcctcggtgccgccaacacc

SEQ ID NO: 57431 - DNA, 101 bp, rice(Oryza sativa)
  misc_feature (71): n=t or c
ctgatctgtacattgagttagcaacactaacactagaatctgaatctgaagagtcatgtgagaagtaagtncctggggcaaaaaactggaccctgggttcg

SEQ ID NO: 57432 - DNA, 101 bp, rice(Oryza sativa)
  misc_feature (71): n=a or g
gatagctgggttgcttttgcctctgcatcaagagcaaaacattttgtgcttgatttgagcccagctgtgcncaccaatcaccaaagtgaagagcacatgta

SEQ ID NO: 57433 - DNA, 101 bp, rice(Oryza sativa)
  misc_feature (71): n=a or g
gcattgctggggcatgagtcatagggcgggttggtgtttgagtgactttaaggttaatcatttgaagaacntcaaggtggcagtgcaagtgcactattcat

SEQ ID NO: 57434 - DNA, 101 bp, rice(Oryza sativa)
  misc_feature (71): n=t or c
cacccccgttaggttaatgaatcccgtttgctttcaaaaggacgtgactattcagagaccgcaatctatantgtcttaactgagactcatcttgcctacta

SEQ ID NO: 57435 - DNA, 101 bp, rice(Oryza sativa)
  misc_feature (71): n=t or c
tggagcatctggcatgatgtgactggttttggctaaattgcttaggaggtggtgtgctatgcctaattgtntacaggtccccattattgacgtttgaacaa

SEQ ID NO: 57436 - DNA, 101 bp, rice(Oryza sativa)
  misc_feature (71): n=a or c
gagcatctgttagagacttggatagtgaacggttgattttgctgtagtattcgcaaagaacatcaagcctnacagataggatcattcgttgcttttcactt

SEQ ID NO: 57437 - DNA, 101 bp, rice(Oryza sativa)
  misc_feature (71): n=a or g
gggggaaatagatggcaggtgggccctacaaattgtttgttttttttcctgactgtattgacacgttgatnctacgtgtgcaagctttcagcccaaacagc

SEQ ID NO: 57438 - DNA, 101 bp, rice(Oryza sativa)
  misc_feature (71): n=t or c
ttggagatgtcagcggagatggggaaagagagtattttgagatcaagacaaagcagagaagaaagggcctngtaattggacggtctgttaacaattatgag

SEQ ID NO: 57439 - DNA, 101 bp, rice(Oryza sativa)
  misc_feature (71): n=a or c
tgaaaatgctgggccgtggcatagtgcatagacaggaggtcacctacccaattgttgtttgaaatagcctngttaactgatatgttcttccttcttgagac

SEQ ID NO: 57440 - DNA, 101 bp, rice(Oryza sativa)
  misc_feature (71): n=t or g
tccattctcttctcatgtagttcgttttcttgttgcctttctgtcttgctctctacagatgctggtgactnttcacattcagctacctttttctccatttt

SEQ ID NO: 57441 - DNA, 101 bp, rice(Oryza sativa)
  misc_feature (71): n=t or c
gatcgtacgtacattattttattccgggatggagattagcagtgtgggagttttaatagatctaatccaanggtctaaaataacgggtccaccaagttaag

SEQ ID NO: 57442 - DNA, 101 bp, rice(Oryza sativa)
  misc_feature (71): n=a or g
atgttatataacataatagtgaattccttatatgccattgaacgtttacctggattgtctgtgatgaagcngacggcggcccaaccaccgcggggaaccaa

SEQ ID NO: 57443 - DNA, 101 bp, rice(Oryza sativa)
  misc_feature (71): n=a or g
agtacgcccgcgtcgtctacctcaggtcctcagccaccaattaatctctcctcccttcctctgcctcgtcnccgccgcggcggccatggccagggttggaa

SEQ ID NO: 57444 - DNA, 101 bp, rice(Oryza sativa)
  misc_feature (71): n=a or g
aagacaatgaagacaacgatggcgatggctagggcaacgacaacgacgacaacaacacaaggacagatccngcgacgccggacttggaagcggccggcggc

SEQ ID NO: 57445 - DNA, 101 bp, rice(Oryza sativa)
  misc_feature (71): n=t or c
cagatgtactgacaggaaagagaggttgtgacacctgaggggtaacaggtgaaggtactccaacatgggcnatagggaacgaagtctgaagtaaatttgca

SEQ ID NO: 57446 - DNA, 101 bp, rice(Oryza sativa)
  misc_feature (71): n=a or g
aatctgcaatgccaagagtgaaagagagatgaaacatgtgatgatgcttgtgagagagactggcttgcttntgaggcagtggtaggcataaggacgggaag

SEQ ID NO: 57447 - DNA, 101 bp, rice(Oryza sativa)
  misc_feature (71): n=a or g
cgtgcccgctcggagccaaacctcacaaatgaccacatggcatatccatgttgctgatggtagcgtgcggntaacatacttgatcagcatgttaaaatctt

SEQ ID NO: 57448 - DNA, 101 bp, rice(Oryza sativa)
  misc_feature (71): n=a or g
ccacccctgaggacgcgatcttagtcctcaatatggggtacccgggtgccacatacctcacactttttatnttggttttaatagttagagagggagtcatt

SEQ ID NO: 57449 - DNA, 101 bp, rice(Oryza sativa)
  misc_feature (71): n=a or g
ggaaccatacatgctcatggttcagagacagtgaaaatccctctgctacttatttatgatgacatcaagantacatatggggacatcaagcctgggagtat

SEQ ID NO: 57450 - DNA, 101 bp, rice(Oryza sativa)
  misc_feature (71): n=a or g
tatagtttcctaataaaatctttggtaatgctgcagctttggggaaataccagttaaagctatagtgatanttctgaaaagaaaataattgtagttttgta

SEQ ID NO: 57451 - DNA, 101 bp, rice(Oryza sativa)
  misc_feature (71): n=t or c
tatttggattgccatcacatcaaacgtgtacaaaatagcaactcacttgggaactttttaatccaccaacnaaaaatatgagcaaggtaaggcgcggccaa

SEQ ID NO: 57452 - DNA, 101 bp, rice(Oryza sativa)
  misc_feature (71): n=a or g
acattacttacatctactagttcccatgccattttctttcaggctttagactttgtggtcagcgaggcaanaaggcataacatgaggttgatactgtcact

SEQ ID NO: 57453 - DNA, 101 bp, rice(Oryza sativa)
  misc_feature (71): n=a or g
cactaggatagtgagcagcatgaggtacttctgcagctgccacgcacggttattgtctgcttccgtcgtcntggcctggccagagcccgcgggctgcagat

SEQ ID NO: 57454 - DNA, 101 bp, rice(Oryza sativa)
  misc_feature (71): n=a or g
tgtgggcatatccattcagtcactggcatgtaggacatcaggagctaaaatctagagctagcaaatctcantagcttaacaactattcgagtattggacaa

SEQ ID NO: 57455 - DNA, 101 bp, rice(Oryza sativa)
  misc_feature (71): n=t or c
ttcaacattgaaagcatcatctcagacgtgcactgcgacatttccagttgggaatatacatcctggttacnagtggcggactcagcgtaaaattatagcta

SEQ ID NO: 57456 - DNA, 101 bp, rice(Oryza sativa)
  misc_feature (71): n=a or c
ctaggttaaatgggccgagatttcccggcccattaacgcacgggtgggaattaggcccacacatcgagatnataaatgggccttcggtgcaggggtcatat

SEQ ID NO: 57457 - DNA, 101 bp, rice(Oryza sativa)
  misc_feature (71): n=t or c
catgatgttggccagagacgacaggccatggatcatcccgaacttcttgttcatggccgccagcgttgggntcgtcctcgccacctccgcgttcttcgaaa

SEQ ID NO: 57458 - DNA, 101 bp, rice(Oryza sativa)
  misc_feature (71): n=t or g
ctggggcgctactcctttcctcgaagacatgccattgttggttacagcatctgttagtctaagtgatgacngtagggatcgttgtgtgaacactgaatttg

SEQ ID NO: 57459 - DNA, 101 bp, rice(Oryza sativa)
  misc_feature (71): n=a or g
cgtcccgttggttgctactactacttactcacttcctcctccttctagtaaagggaggagcaggtacacgngggttgagatctgaggagggaggagaggag

SEQ ID NO: 57460 - DNA, 101 bp, rice(Oryza sativa)
  misc_feature (71): n=t or c
tcatgtaaaaaaaatacgaggagagaaaccagctctatgtgtagcagaacacttggagttcatttacaagnacggggtcatcactaatgaatagtgatggg

SEQ ID NO: 57461 - DNA, 101 bp, rice(Oryza sativa)
  misc_feature (71): n=t or c
actagcttagctagtttgaccaatcttcagctttgattgagacgctgacttttcctagtgtaagtttgacnactgcactaattatctgcatcgatccaaac

SEQ ID NO: 57462 - DNA, 101 bp, rice(Oryza sativa)
  misc_feature (71): n=t or c
ttttccaccctctcttttgaaggtgcaagatcctgatgatccatcgcagacattgtatgacactatgattngccaccatcctccggtgcgtacattgtaca

SEQ ID NO: 57463 - DNA, 101 bp, rice(Oryza sativa)
  misc_feature (71): n=a or c
cgttcccaacgaggccattctaactcctttatttaattttcccaacgcgtgaagtacagtgccccagttcnagaaacaaaaaaggcaacaaaaaaaaaaga

SEQ ID NO: 57464 - DNA, 101 bp, rice(Oryza sativa)
  misc_feature (71): n=a or g
cggcgcaccggcaacgcataagcatgcaaattaggccgaggtgcacagaacagtaaaaggagacgtgtaanacagtcagatatccaaaaaaaaaccaaaat

SEQ ID NO: 57465 - DNA, 101 bp, rice(Oryza sativa)
  misc_feature (71): n=t or c
tcttccccttcatcagccacatcgacatcacccgccgcctcgatcgaatctacagagttcttcttccaaangacacgaccctgccatccgcatctgcagga

SEQ ID NO: 57466 - DNA, 101 bp, rice(Oryza sativa)
  misc_feature (71): n=t or c
tctccacagtagcccctgagacctttatagtcgacgaaacagccttctctcggaacgtaaagtgataatcngagtgcttcaatttctttcgtactgatctc

SEQ ID NO: 57467 - DNA, 101 bp, rice(Oryza sativa)
  misc_feature (71): n=a or c
ttcgattatattgctcgcatacatgagtggtccatgcaaaagagagggattaatttctcccgggtcactcnctcgagcttaattgcgcgatgtgacacctg

SEQ ID NO: 57468 - DNA, 101 bp, rice(Oryza sativa)
  misc_feature (71): n=a or g
gcttctttcttcacctttccttccatgaccactttgatctgagttcctcccattctctccgccaatgaggntctctgttgcgcctcgcccccaccctgcct

SEQ ID NO: 57469 - DNA, 101 bp, rice(Oryza sativa)
  misc_feature (71): n=a or c
atgaaaaactgaaagcagtgtacctctgatcaatccggcatgtcagagtcaagctaatcatgttcctgagntcttcatcgctcatcttgctacgagcataa

SEQ ID NO: 57470 - DNA, 101 bp, rice(Oryza sativa)
  misc_feature (71): n=a or g
tttctaccaccgctctccaaatttctgttgttggttctgaatttttacggtctttctcttcttcacctcantcccaactccatcacttttctgagcatctt

SEQ ID NO: 57471 - DNA, 101 bp, rice(Oryza sativa)
  misc_feature (71): n=t or g
atacatgaataatgaattaacgtttgaatttttgattgattatacgaagaagaaagctgccgcgtcgtcgncgtcatcgtcatcggtctcgtcgaaccgca

SEQ ID NO: 57472 - DNA, 101 bp, rice(Oryza sativa)
  misc_feature (71): n=t or c
tacatactgtgatcagtatctcaccggtcattatatttgaagtgttgagcaggcaaccctagagcaggtanttgtacgccatcctgaaataacaacttaag

SEQ ID NO: 57473 - DNA, 101 bp, rice(Oryza sativa)
  misc_feature (71): n=t or c
caaagtggaacaatcaagagataggagtccttgatgtgaaactgacacagctgatagaagtggacaacgcngctcaagagcacaaatcagcaagaaaaatt

SEQ ID NO: 57474 - DNA, 101 bp, rice(Oryza sativa)
  misc_feature (71): n=t or g
ctgcttaaaaatagttgtccacgtattcgtttttaggtaaatggtgttataggactgcctaaaataaattngttattatgaactttgattgatcttatcag

SEQ ID NO: 57475 - DNA, 101 bp, rice(Oryza sativa)
  misc_feature (71): n=t or g
ttgcaactgttgacattaatatatattgaggcgttgatcagcacaaacctgtcaagttgacattattgaancattgttggaggcattgatatattagcaca

SEQ ID NO: 57476 - DNA, 101 bp, rice(Oryza sativa)
  misc_feature (71): n=t or g
gcctaggaagcaaatagccgggtgttaattaatccatgttcgcggtgagcattcttaattctgctagctcnactccctgacaggctaaagtcccctgaacc

SEQ ID NO: 57477 - DNA, 101 bp, rice(Oryza sativa)
  misc_feature (71): n=a or c
gggtcattaattttttttataaaatataaaaatccagtggcgaattcactgaattttttacattttagtcnttttgaaaatcttattttacaaatataccc

SEQ ID NO: 57478 - DNA, 101 bp, rice(Oryza sativa)
  misc_feature (71): n=t or c
cagaaaaaaatgacttactgtccttgtgggacaggcaagtgtaataaaggatataaaatcatgagaaccancaaacaattggagtgcttctatgtagaacc

SEQ ID NO: 57479 - DNA, 101 bp, rice(Oryza sativa)
  misc_feature (71): n=a or g
attgtgtcctgtgctacaattcaggttgaacctgccggttcaagaggaatggcggggcaagcccatgtagngcgagcacgactgctgcccgtcgcagaaca

SEQ ID NO: 57480 - DNA, 101 bp, rice(Oryza sativa)
  misc_feature (71): n=a or g
cacaagaaggtagtgctgtacttgcactaattctgaatgttgtctgtagttggagttgagctataatccgnttgggccagagggggtaaaggctctttgtg

SEQ ID NO: 57481 - DNA, 101 bp, rice(Oryza sativa)
  misc_feature (71): n=a or c
gtggagactaaagatccaagccactttattacggaggcaaacaaagagaggctcagacaagcaaaagaagncaacagggtgcaggtactgtcacagttttg

SEQ ID NO: 57482 - DNA, 101 bp, rice(Oryza sativa)
  misc_feature (71): n=a or g
agacttccctccaccgggccaagatgatgagacgttgtttgtccgtgatgttctctcttctgtcacattgncattagcgccgttcgtccaggattctctcc

SEQ ID NO: 57483 - DNA, 101 bp, rice(Oryza sativa)
  misc_feature (71): n=a or c
caagcaggcccgtggggtggccctggtggaagtgctcgtacggtgagctcctaactaatcttatcttatangtatttatgagtaatttgttgacattcaca

SEQ ID NO: 57484 - DNA, 101 bp, rice(Oryza sativa)
  misc_feature (71): n=a or g
atgggtcctgaaaatttgttgttagagagatccaacacttctaagcccctaagtttattgagctcttttgngattagtccgtggaggagatttgcttgcaa

SEQ ID NO: 57485 - DNA, 101 bp, rice(Oryza sativa)
  misc_feature (71): n=a or g
taattgattaaattatagttgcgtcagttataaaatggcaagataaccactcttatcactgtcctcacctnctagatcaagtctatcatagaaatatctat

SEQ ID NO: 57486 - DNA, 101 bp, rice(Oryza sativa)
  misc_feature (71): n=a or g
atggctgggtttcttcttcttcttctcggtgacaaaagatatttgtacagctgattggttcttgggattantattaaaaattatatattaacttttagcaa

SEQ ID NO: 57487 - DNA, 101 bp, rice(Oryza sativa)
  misc_feature (71): n=a or c
acttgaacatttgtggacaaatccatcacaacaaaactagcatgttgaatcaccctcacttcacggctcanaaaatttattttttttgaacgactcgcacg

SEQ ID NO: 57488 - DNA, 101 bp, rice(Oryza sativa)
  misc_feature (71): n=a or g
caatccatatgaagaaggactagtatagatcgatcgattatctgcgtaccggcgatccactgactcaagcngcggcggcgactccggcgaggggtttgcag

SEQ ID NO: 57489 - DNA, 101 bp, rice(Oryza sativa)
  misc_feature (71): n=t or c
tacagtacagaggatttgcatggatggatcggatcaagaagaaggtgaggcagagacgaggaatttaattnagatcttgccgcgtgggccgggcgtcggcg

SEQ ID NO: 57490 - DNA, 101 bp, rice(Oryza sativa)
  misc_feature (71): n=a or c
ataatgaggggatttctgcaaaaatcgatgagtggatctgcagggcccgcagttaatctaacgcttattanggtggtgtttggatcagggacttaacttta

SEQ ID NO: 57491 - DNA, 101 bp, rice(Oryza sativa)
  misc_feature (71): n=t or g
tggtggcctaggttaggtggggaggacgggttcacactacacacgtgcacgtttcggggaaacgaatgagncggctgggcccacccgtcagtctaaatagc

SEQ ID NO: 57492 - DNA, 101 bp, rice(Oryza sativa)
  misc_feature (71): n=t or g
tattttccagttcttagttcttttatgtgcttgcagagaaactgccgtcgtggcattatggggtccccatnctacacaattccacgctgaaaacttgcagc

SEQ ID NO: 57493 - DNA, 101 bp, rice(Oryza sativa)
  misc_feature (71): n=a or g
gagtatatacgataatgttcagatgccatatgacaaatgcattttcattaattagatgtggagggcaagtnagaaactatcaaacaaatcatatagctttg

SEQ ID NO: 57494 - DNA, 101 bp, rice(Oryza sativa)
  misc_feature (71): n=t or c
tctatttttcttcctccaattaagtatttttgctctcctcccttctccccatctccccagtcttctcctcnccgtctcctctcctccatcggctctccttg

SEQ ID NO: 57495 - DNA, 101 bp, rice(Oryza sativa)
  misc_feature (71): n=t or c
gaatccccctcatccgtgccctcttttccctgttcatttctgttccccttttctttgtgttgagatccagncatggactcgtggaaaaaaagatcgcgttc

SEQ ID NO: 57496 - DNA, 101 bp, rice(Oryza sativa)
  misc_feature (71): n=a or g
ctaacttggagaaatcgacggggaaagcgataatgcaggattgaacaagtcgacttaccgcggggatctcngaggtgtagaatggggcggaagccattgtt

SEQ ID NO: 57497 - DNA, 101 bp, rice(Oryza sativa)
  misc_feature (71): n=t or c
catagaactcgtccatcggagcatgcttcaagtggtagagaggaacagttttggcaggattcgacgtttcnggatgcatgatcttgtacgtgaactagcca

SEQ ID NO: 57498 - DNA, 101 bp, rice(Oryza sativa)
  misc_feature (71): n=a or g
cctatctcgaattctcaacattgtgattattgtttttttttggcaaggggcaagggaaggtgtaagacaanaacaggtgaccatttctctttagctaaaaa

SEQ ID NO: 57499 - DNA, 101 bp, rice(Oryza sativa)
  misc_feature (71): n=t or c
tccataagacgtaacatggatttcaaatttaataccagttccggcaaatcaaacaggtctggggaaaaagngggcaacgttgtcataataattacaaatga

SEQ ID NO: 57500 - DNA, 101 bp, rice(Oryza sativa)
  misc_feature (71): n=a or g
caattcaagggtctcaccggaatcttctttttgaatggaacaatgagcatccggttctagaagagaattangggactcatgaagtagtaccgccattactt

SEQ ID NO: 57501 - DNA, 101 bp, rice(Oryza sativa)
  misc_feature (71): n=t or g
cggttttgttttgttgtgggaaatttagatttgttttttgaaacactttgaatattccagtacgtgaaatngcgtggagtccggataagttgcatgcgact

SEQ ID NO: 57502 - DNA, 101 bp, rice(Oryza sativa)
  misc_feature (71): n=t or c
actcatgtgtgttatagttacagaaggagacaagtaaacaaatgagaaacagaacagaacagattacaggntacacatctgagtatctgacaccacaaact

SEQ ID NO: 57503 - DNA, 101 bp, rice(Oryza sativa)
  misc_feature (71): n=a or g
tatccaagaaaccaaggaaaagatcgcacaaatcggggtaaagatcgaggaacggcttcttatcgaatgcntagttgaggagattaaagagcttttgggag

SEQ ID NO: 57504 - DNA, 101 bp, rice(Oryza sativa)
  misc_feature (71): n=a or c
tgtgcgtccggtctgactgatcccgggtagagagctgggggcacattacaattgatttaaagaccggattnattgtgaattcggacatttgtgcccataag

SEQ ID NO: 57505 - DNA, 101 bp, rice(Oryza sativa)
  misc_feature (71): n=a or g
acggtcaaacgttgggcactgaaacccacaactgcgcttaatatgccacaactgcgcttaatatgggacanagggagtactttctacaaacacttttttta

SEQ ID NO: 57506 - DNA, 101 bp, rice(Oryza sativa)
  misc_feature (71): n=t or c
gcctcatggaggaccagtgggtgccaaccgggaggggcctccttctcatcagcttttcgtttccttcttanatagcaccatgcaaatagaaccacacttgt

SEQ ID NO: 57507 - DNA, 101 bp, rice(Oryza sativa)
  misc_feature (71): n=a or g
gaaaagaatgtacactggcaattttgtttcacaactcattgttcaaaacctacaattttaatgcaccgatnattaatatggaaatattgtgtatttggcag

SEQ ID NO: 57508 - DNA, 101 bp, rice(Oryza sativa)
  misc_feature (71): n=t or c
aacgttgtacacagcctccctcatgtcgaactggttgatcaagaactggaacatgatctcctcctcgccgncgccgccgttgacaccatcgggtagcacct

SEQ ID NO: 57509 - DNA, 101 bp, rice(Oryza sativa)
  misc_feature (71): n=t or g
agagagcaagaggaggaaggaagaagaagaagaagcttcaggatttcagagactcagagggcaatggactnagatagagggcagcagatatataggcagtg

SEQ ID NO: 57510 - DNA, 101 bp, rice(Oryza sativa)
  misc_feature (71): n=t or c
tccagtaccgactattagattcggatctacttcgtaatggttaaacgtgtccggatactgtagctcacggnactaaaattgtttattacttttacatatag

SEQ ID NO: 57511 - DNA, 101 bp, rice(Oryza sativa)
  misc_feature (71): n=a or g
tctgactcagctctaactgcagtctgcagagctatcttcaggagatctgcgccatatatagataagctgcnggatcctacatagcatagagaaacttacat

SEQ ID NO: 57512 - DNA, 101 bp, rice(Oryza sativa)
  misc_feature (71): n=t or g
ttgctgctgaggtcgtccaactctcatcgatatcagatttccaaaatggaaaggaaaaaggacaccgaagntccctcgacttgttatcgggataaaaaatg

SEQ ID NO: 57513 - DNA, 101 bp, rice(Oryza sativa)
  misc_feature (71): n=t or g
aaactattataagacttatttatagattatagaatctgaaccttttgcccacatgagctcgcctgacaagntaaaacaacactaacacaccatacatagcg

SEQ ID NO: 57514 - DNA, 101 bp, rice(Oryza sativa)
  misc_feature (71): n=t or c
tatacttattaatatgttccacatttaagcgcatgtatcatttgttgtttcatgataagtactgataatcnctgatgttttattattttttttctttttac

SEQ ID NO: 57515 - DNA, 101 bp, rice(Oryza sativa)
  misc_feature (71): n=a or c
aggaaactctcctcaatttggggcgtgtttgacctatttatcttctccaaacaactttcttttgggtcctntctaccacaagccctagatagatagactag

SEQ ID NO: 57516 - DNA, 101 bp, rice(Oryza sativa)
  misc_feature (71): n=a or g
tccaggatattctttcccccttcccagcccagttgaaagaattcgcgtgctcctacctcggcctacctctncacatcagaaagcttcggaggcttgatgtt

SEQ ID NO: 57517 - DNA, 101 bp, rice(Oryza sativa)
  misc_feature (71): n=a or g
tgtagtgagcctattcaaatgccaaattaaggagattctgctagttccttgaaaaaatagaaaaaaaatantctatctttctaacatgggtttcttttcga

SEQ ID NO: 57518 - DNA, 101 bp, rice(Oryza sativa)
  misc_feature (71): n=a or g
ttcatctttatttacgggagaaaaaaaaaacatttgaagcccacctgagttcatcgccctggtctcacatngaggagtgcaggcgaacagtgtggcggagt

SEQ ID NO: 57519 - DNA, 101 bp, rice(Oryza sativa)
  misc_feature (71): n=a or g
tcgctcacgggcatcacgagcaatagcaaaagcttctctggctgcatcacctgcagtcggatgcacgcatncacgccgctgccgtacgtgacaccggctgc

SEQ ID NO: 57520 - DNA, 101 bp, rice(Oryza sativa)
  misc_feature (71): n=t or c
gattatgatatatattttatctcagtttctgttagcatggtgttttatttgctaaatgatgcatttcgtangaaaacattatatattaagttattttaaaa

SEQ ID NO: 57521 - DNA, 101 bp, rice(Oryza sativa)
  misc_feature (71): n=t or g
tagtagcatcacacaatcgccaaactactacacagtggcgcatcaaccacaccgcaaaagaatcacaactnctattaaaacttatctctacacagtggcgc

SEQ ID NO: 57522 - DNA, 101 bp, rice(Oryza sativa)
  misc_feature (71): n=t or c
ctgttaaaacagggcctagagacataactatagtaggtatggaaaatacattcgagtgtgatcctgggacntatagaacacttcttagcatcccagcaact

SEQ ID NO: 57523 - DNA, 101 bp, rice(Oryza sativa)
  misc_feature (71): n=t or g
tcctcgctaaaaagcacgcccatgtatttgtgttgtgcgtgctgctcaattatttcaagtttaaacagtcngtgtgcagcatatttcaaatataaaattgt

SEQ ID NO: 57524 - DNA, 101 bp, rice(Oryza sativa)
  misc_feature (71): n=t or c
taaaacatgtagaaatcgtgatgggctgatgacagaaccaccaccatcactattatcttttatagtattcnctccgtcccaaaatataagaacgtaggatc

SEQ ID NO: 57525 - DNA, 101 bp, rice(Oryza sativa)
  misc_feature (71): n=t or c
tccgtcaccgaatccctccggcgtaggccactcccgtctgcccacttgctgccatcgtcattttcgtggcngtcaccaccgtcatcgcgaccacggtgaag

SEQ ID NO: 57526 - DNA, 101 bp, rice(Oryza sativa)
  misc_feature (71): n=a or g
tctgacgtaacatatatttcttgtcagggccttgctgcgcatctaagcgccaagaagtctgccctagagcngcttgatgggtactgccttcgccttcggaa

SEQ ID NO: 57527 - DNA, 101 bp, rice(Oryza sativa)
  misc_feature (71): n=t or c
acaccagaaatgattcagtatgcccgttgtgatgcgcattatctgttgtacattgcaaattgtttggcatnagagcttcatgcaaaaacttacggtatgat

SEQ ID NO: 57528 - DNA, 101 bp, rice(Oryza sativa)
  misc_feature (71): n=t or c
ggcatcaagggctcttctattgttcataatgttggtatccaccccaacagtttcagctaggatatcaatcncttcaatcttatccatgatttcttttttcc

SEQ ID NO: 57529 - DNA, 101 bp, rice(Oryza sativa)
  misc_feature (71): n=t or c
agcacgcacgcaggatgttcaccttctgggcgtgggtgcttttcctgatccttggactaggaggggatctnttggtgtcggctgcaccccagcttcagtgc

SEQ ID NO: 57530 - DNA, 101 bp, rice(Oryza sativa)
  misc_feature (71): n=a or g
gcgcagtttgcaacgttgcatttcactggaaatgcagcgctctggttgcaaacctatgaagaattgcatantgtggagagctgggcagagctatgtgtagc

SEQ ID NO: 57531 - DNA, 101 bp, rice(Oryza sativa)
  misc_feature (71): n=a or g
cggccgagattgagaaagaagaaggagacaagaagatcaagatcatggtctcaaatccggcgtacaaggcntggttcgcccaagatctacaagtgctcggg

SEQ ID NO: 57532 - DNA, 101 bp, rice(Oryza sativa)
  misc_feature (71): n=a or g
gaaaagatgtcccttaaaactccccctaccgaagaacttgagactggccttcatcattttgttgaattatncaaacagttgaattataccctatttagctc

SEQ ID NO: 57533 - DNA, 101 bp, rice(Oryza sativa)
  misc_feature (71): n=a or g
aagaaaagcattgcactgctcgatgcatgcatgatgagtaggagcaggaagggcaagttttataaaagagntggatgttgcatctaatcttagaccacatc

SEQ ID NO: 57534 - DNA, 101 bp, rice(Oryza sativa)
  misc_feature (71): n=a or g
ccgcgcaaccaccgcatcgatctcccatccattcccggccaatttcacaccaaatcgcatcatccaattcntatccatggcggaggagagagaaagcttcg

SEQ ID NO: 57535 - DNA, 101 bp, rice(Oryza sativa)
  misc_feature (71): n=a or g
tgaatttcataaataagaatcaacaggaggtagataatcaaattgttttattgtgacatcccggcctaagntttaataggattaatagaatactcatatta

SEQ ID NO: 57536 - DNA, 101 bp, rice(Oryza sativa)
  misc_feature (71): n=t or g
aagcatgccccacagaacctctgaatacttgtagtcatatgcgtcatcagatatctgcataattgtcatantattataccaaacttgcggccaaacagact

SEQ ID NO: 57537 - DNA, 101 bp, rice(Oryza sativa)
  misc_feature (71): n=t or g
tttttctcccttctttgcacaacctctcccctcacctatcaccgacgctccaagacagcatgggagagcangcgacagttggcggttgacgagctcgatgg

SEQ ID NO: 57538 - DNA, 101 bp, rice(Oryza sativa)
  misc_feature (71): n=a or g
ccttgtacagttgcaagttctcggtgtcatcctcagttgctccaattgctccaatgagcaggttctcatcnagctcgccaaatccataggaaggtctccac

SEQ ID NO: 57539 - DNA, 101 bp, rice(Oryza sativa)
  misc_feature (71): n=a or g
tacggtatcagcggtcgggtccagccagcccaggatcgaggaaagggaacaaatcatcgatactacggctntgtttagagctgaaaaagttgagaggctgg

SEQ ID NO: 57540 - DNA, 101 bp, rice(Oryza sativa)
  misc_feature (71): n=t or c
taaacttatattatataatagctctaaataatacaactgggctaatctaacgagcgcactacaggtgcgcngattttctacttaattctgagctggtttgg

SEQ ID NO: 57541 - DNA, 101 bp, rice(Oryza sativa)
  misc_feature (71): n=t or c
cccgcgcccgcgcttcgatgccttccatggagatttctagcgccatcttcgcctacataaaacctcgaatnctccacgcgcgcgcgagaaagacagcgacg

SEQ ID NO: 57542 - DNA, 101 bp, rice(Oryza sativa)
  misc_feature (71): n=t or c
catggactgatgtaagcttgcgtagaagtcaaattgatttctcttgcccgtccatttcccctggacgaacngcataaagttgactcgttgatcaaaaccgt

SEQ ID NO: 57543 - DNA, 101 bp, rice(Oryza sativa)
  misc_feature (71): n=a or c
tcgaatgccatatagcaatcctcttttttttaatggatcaatagaatcctttaagttttagacaagaattntgtagtattgttgtgagtgatccgagcagc

SEQ ID NO: 57544 - DNA, 101 bp, rice(Oryza sativa)
  misc_feature (71): n=a or c
agtccatcatccagcccatctaacggcccaaacttctcctcttcttcctccctcgccgccggcaacccccngcgccgccgcgattcggtcgcgtccaccct

SEQ ID NO: 57545 - DNA, 101 bp, rice(Oryza sativa)
  misc_feature (71): n=a or g
atatcttcaggtacactagtcataagattgttacagaacataactgaatatgctccaccaagggggaaaanggggatatcatcatatattgagaacaacaa

SEQ ID NO: 57546 - DNA, 101 bp, rice(Oryza sativa)
  misc_feature (71): n=a or g
acatatggatcccatggtttttctgattttaagtgccacgtcagctgaaatcattattcaaaccaccttgnaactactggttttgggtgttgagggatgtg

SEQ ID NO: 57547 - DNA, 101 bp, rice(Oryza sativa)
  misc_feature (71): n=t or g
ggtgagcaggatattgtcagccatgtagcaatgtggatgcagatggggacgacaatgtcattagcaacaangcagcctcctccacacccatcagaagcctc

SEQ ID NO: 57548 - DNA, 101 bp, rice(Oryza sativa)
  misc_feature (71): n=a or g
aatttggttttctttttctctttttttttgccaaaaatagttttctttaatagcaaacaaaacaaagactnaatataatagattgtattttaccaaatttt

SEQ ID NO: 57549 - DNA, 101 bp, rice(Oryza sativa)
  misc_feature (71): n=t or c
aatcagcattaccacttgtacaactataccaatccccagatcgatcgtgtactctgacaaatgcatccacnattaacggcataacctcaaagacaggagtc

SEQ ID NO: 57550 - DNA, 101 bp, rice(Oryza sativa)
  misc_feature (71): n=t or c
tttgagtccgcactcaaatcctcttcatttactccttcgaaggttccacgttttcaaatcttagaaccggnaaaccctaaaacctaatctacctctcacct

SEQ ID NO: 57551 - DNA, 101 bp, rice(Oryza sativa)
  misc_feature (71): n=a or g
aaaaaataataaaaatatttaatgggcccatgtgtcatatctcttcatagtatctctacctctctctctantgctcaatgggagagacggatgaggaggag

SEQ ID NO: 57552 - DNA, 101 bp, rice(Oryza sativa)
  misc_feature (71): n=t or c
aggttaaagccaaaactaacagtactgtttctcactagctatgcagaagaaccgcttgaatacagtggtgnctcctcgtagctattggcaacagaagcgct

SEQ ID NO: 57553 - DNA, 101 bp, rice(Oryza sativa)
  misc_feature (71): n=a or g
cttgaaagtgaggaacccgaaagaataagaacctcaagggatggaattgtgttcaccacaagaggtgatcnatatatcatttactgcgcttaggtttacgc

SEQ ID NO: 57554 - DNA, 101 bp, rice(Oryza sativa)
  misc_feature (71): n=a or c
cagctgcgcagtaagcgggaaactgagggtggcaggtttagaagatgacttcgtttcatccttcaggtttncttgagtgtgtaaacggagcttgaaatttg

SEQ ID NO: 57555 - DNA, 101 bp, rice(Oryza sativa)
  misc_feature (71): n=t or c
agataatgaagatatacagcgcattgtattgtacttggggtgccatctcattctacctgggacaacatagngtgtagatcatagatgatggtgcatccatt

SEQ ID NO: 57556 - DNA, 101 bp, rice(Oryza sativa)
  misc_feature (71): n=a or g
gtctttttcagaaaaccagggtacaagctctagttggtagcctcacaaccaaattacttaccaccttgctntaagcacattatcgatgatttcaactctta

SEQ ID NO: 57557 - DNA, 101 bp, rice(Oryza sativa)
  misc_feature (71): n=t or c
ccacgtaatgcatatgggtctccagcttgctgtttaatcgccatcagccgggagcccgggaaaatttgttnggcccaatagaatagtttacggcatggggc

SEQ ID NO: 57558 - DNA, 101 bp, rice(Oryza sativa)
  misc_feature (71): n=t or c
aggaacttttctcctgcacaagactagggatatggggaatgaaccgccgctaccagatgatgaaatttgtntcgatggaggaagtgtgcgcccagatcgtc

SEQ ID NO: 57559 - DNA, 101 bp, rice(Oryza sativa)
  misc_feature (71): n=a or g
tttagtcggataagcaaactgtgtgaccattgatatatgttacctatactcttcacaatcggcctcctccngtgagatgcatccatgatgacgataaatct

SEQ ID NO: 57560 - DNA, 101 bp, rice(Oryza sativa)
  misc_feature (71): n=t or g
ccaaactgttttgggtggggtacggttactgccacttccatggtaaggtggttatcacagtaactgcatgnttagtgaaaaccgtgctgttacctatttgg

SEQ ID NO: 57561 - DNA, 101 bp, rice(Oryza sativa)
  misc_feature (71): n=a or g
aacactatataacttttataatgtacacttatacgtcaggaccaagaaaattctggccatgctcagatacncttatatgtacagttattttaattttcatt

SEQ ID NO: 57562 - DNA, 101 bp, rice(Oryza sativa)
  misc_feature (71): n=t or g
gcccgtaaactgaaaggatctagtttctgcagttctggtcaggatgttgcggcacctctcatctgtattgnttggagagactctagcctcagtacgatcaa

SEQ ID NO: 57563 - DNA, 101 bp, rice(Oryza sativa)
  misc_feature (71): n=a or c
tctccaggaagaagaggaacaaggacaaggagagcttgtacatgaaggagctttacagcttgcttaggctnagctagctgatcagtgtgatctgatctgtg

SEQ ID NO: 57564 - DNA, 101 bp, rice(Oryza sativa)
  misc_feature (71): n=t or c
cttcgaggtatacctactaggtattaggcgatacatataaggtatcaccctgtccgaaaggatactgtcangtagcattaccctataattatctaccgatc

SEQ ID NO: 57565 - DNA, 101 bp, rice(Oryza sativa)
  misc_feature (71): n=t or c
gagtagtgttccgcttgacaaccaccaagccgaaataggtgctctgtgttatagctgttcacctaggctgncacttaggcgcttaacccacttggttaggc

SEQ ID NO: 57566 - DNA, 101 bp, rice(Oryza sativa)
  misc_feature (71): n=t or g
aggagacgatgcagaattgcagatataaagaggacgagagagagagcaggtgaaatgaacgaaatggggtntggtggtagtagcggcctgcgctttggact

SEQ ID NO: 57567 - DNA, 101 bp, rice(Oryza sativa)
  misc_feature (71): n=a or c
ccggaggttggaaggttaagaaacctcacttcgctagaagctgagcacacattccttgaagctaaagatcngaaaggatggggattcatatctgcgttaac

SEQ ID NO: 57568 - DNA, 101 bp, rice(Oryza sativa)
  misc_feature (71): n=t or c
atgtgacgcatcccttggcgcacaaatgttggccgcaaagtggatttgagaccaaatcgatcaggcaaacngacatttagaaaacagagaaaagcaacaag

SEQ ID NO: 57569 - DNA, 101 bp, rice(Oryza sativa)
  misc_feature (71): n=a or g
tagcgcatgcatgtctcagcctttatcactgactactctactctgattatataacaacctaatagggaatnagacatattctaatattacaaatgtgaaca

SEQ ID NO: 57570 - DNA, 101 bp, rice(Oryza sativa)
  misc_feature (71): n=t or c
agaaaaaacacacaagtttttggcgtcgtaccagtaccagtcgacatgtaaatatgggcctgtttagtttncaaacaaaatttttcacgctgtcacatcga

SEQ ID NO: 57571 - DNA, 101 bp, rice(Oryza sativa)
  misc_feature (71): n=t or c
gttttattgtgctaaaatttgattagcgatgtggtatgcaaaaccataatagcggagttatgccatgtganaaaacctcgtggtttactaacttggatcgt

SEQ ID NO: 57572 - DNA, 101 bp, rice(Oryza sativa)
  misc_feature (71): n=a or g
gggtttgtcttttttttgggacggagggagtactccagtaaactcttctactggtatggttatatatagcnttgacgactggattgttgtagcttgttttc

SEQ ID NO: 57573 - DNA, 101 bp, rice(Oryza sativa)
  misc_feature (71): n=a or g
atgtcgttgaaaagattgatgttatcatcttcagtactactcggtgatcaagaactcactctgtgcggcgncggccatggcggcggcggaggcggaggagg

SEQ ID NO: 57574 - DNA, 101 bp, rice(Oryza sativa)
  misc_feature (71): n=t or g
atctctttcatcaacaggcaagctctggtactcatcacagcccatcatgacatgccatggcactccacagntgatacagatatctctatggcattctgggc

SEQ ID NO: 57575 - DNA, 101 bp, rice(Oryza sativa)
  misc_feature (71): n=t or c
acccaagattctccgacatgtccacaccattttcctccacctccaacgggagcgtccactcgaagcgatgnagcagcgaccccagcattgcgtgcagcatc

SEQ ID NO: 57576 - DNA, 101 bp, rice(Oryza sativa)
  misc_feature (71): n=a or c
gaagtactaaactaattacagacagacaattatacatatttatttggtaattctctatgagtggttgtgcncttttacacaaatctagggttttgtctgac

SEQ ID NO: 57577 - DNA, 101 bp, rice(Oryza sativa)
  misc_feature (71): n=a or c
tgctttgactccagggacatgtcctgatgtgcatgccggattctgattgacaacagagactagggttatcnaagaagctgtcctcgtatgctagcgtttgc

SEQ ID NO: 57578 - DNA, 101 bp, rice(Oryza sativa)
  misc_feature (71): n=t or c
tggtggtgctaagcttctttcaaaaacactattggtggtagcggttgcactactagagaaatgatctttgntgggtcaacccaaaaccacaatagtcccgg

SEQ ID NO: 57579 - DNA, 101 bp, rice(Oryza sativa)
  misc_feature (71): n=t or c
gatcggttactcaacgcccaagtgatgatcgatcgatgaacacagcgacgacttctgagagagtgactttncaggtcgttttgtacgctggcgttttgtag

SEQ ID NO: 57580 - DNA, 101 bp, rice(Oryza sativa)
  misc_feature (71): n=t or g
cacagagagaaccagccaaatgatgtacgatgggaatcccctcttattccctggtgctctcacatgtgaancaagaacaccctcctcttcctcctgcttgt

SEQ ID NO: 57581 - DNA, 101 bp, rice(Oryza sativa)
  misc_feature (71): n=t or c
aactgattatgcagtcagcacaggacaggacatataagatgtatacaacacttcgtgtcttcctttagaanactggaatttcatgagttttgcagattttt

SEQ ID NO: 57582 - DNA, 101 bp, rice(Oryza sativa)
  misc_feature (71): n=t or g
tacggctgctgtgatgctgtcctcttagatgatccgttggtagaagcggttcagtgttttagctgagaagncttatgatcaacattcaataacaagtggtt

SEQ ID NO: 57583 - DNA, 101 bp, rice(Oryza sativa)
  misc_feature (71): n=t or g
agtggtttggtattgaagatgtgcaatccagattctgaatccttaccgtttatctcagtaaggagtagtcncaagctttgaaatactcaaatacaagcagc

SEQ ID NO: 57584 - DNA, 101 bp, rice(Oryza sativa)
  misc_feature (71): n=t or g
aaccaacatgtccagaaaggagtcctcctcctcactgtagtagccatccttagaaccatatgatctttcanaagtgctcatgttcctatatcaatacatga

SEQ ID NO: 57585 - DNA, 101 bp, rice(Oryza sativa)
  misc_feature (71): n=a or g
ctcatttgcacaatagttacatactatactattaatactgatcccacttgttatacatacaccgtgtcttngagtccgtgctatagctggctacaaatctg

SEQ ID NO: 57586 - DNA, 101 bp, rice(Oryza sativa)
  misc_feature (71): n=a or g
gaaaccaagtgaactataggtggtctaggtacagaatacgccacatttgttacatctctctaggtttgagnccacaagagatggtgaatatacgaggtttc

SEQ ID NO: 57587 - DNA, 101 bp, rice(Oryza sativa)
  misc_feature (71): n=t or g
tatcagacattgcttatttctcatgttgtttctctttgttcattggtgcagaggcttcgatttataaccantgtaactataagaaaaatctgcaacgagaa

SEQ ID NO: 57588 - DNA, 101 bp, rice(Oryza sativa)
  misc_feature (71): n=a or c
caatttttacatctatcttggtacactccatcgagatatgctcaatctacatcacccaggaaatttatcantcgggagcatattaattggcgtgctataca

SEQ ID NO: 57589 - DNA, 101 bp, rice(Oryza sativa)
  misc_feature (71): n=t or c
aaagtccaagatttaaaatcaacttggaaggttgaagtatttatacttgctcttagatccttggtgcttcnccgtttaaattatttgtcgttttagctatg

SEQ ID NO: 57590 - DNA, 101 bp, rice(Oryza sativa)
  misc_feature (71): n=a or g
cgtcggcacaaagtggaagctaggacttaactgtagccgtgacaccagctcatgcttccagctcaccactngcaccgccgacccatcaccgtcgttgccgc

SEQ ID NO: 57591 - DNA, 101 bp, rice(Oryza sativa)
  misc_feature (71): n=a or g
aatcccatacccactcccacatttgctgcgttaaagagcagccctaaaggataagttggcaagtctcgccntcgttcgagtagaggtggtatactagcgcg

SEQ ID NO: 57592 - DNA, 101 bp, rice(Oryza sativa)
  misc_feature (71): n=a or g
agtctcactaagattaaggtggtgtttggattccctaactaaactttagtccatatcgtattagatgtttngaactaatttagagtatcaaacacaaacta

SEQ ID NO: 57593 - DNA, 101 bp, rice(Oryza sativa)
  misc_feature (71): n=a or g
catgttggttgctagtggtgcagaagacattccagtgtggttcctgttcatatttgtggtacgccgtacantaactttttgaacaaagatactcagaatcc

SEQ ID NO: 57594 - DNA, 101 bp, rice(Oryza sativa)
  misc_feature (71): n=a or g
acaattaacagctggctgtattgttagccttgctctgatgctagctcctgtttcgccctgctccgacatanggggaagtctaattcacatatttttataat

SEQ ID NO: 57595 - DNA, 101 bp, rice(Oryza sativa)
  misc_feature (71): n=a or g
atttctaatcaagtcttttggattttctatttttcacgttatgaagatgcacgtaggacttctggtgctcnccatgatcagaagcatgaaggtgtatctgg

SEQ ID NO: 57596 - DNA, 101 bp, rice(Oryza sativa)
  misc_feature (71): n=a or c
ttacacctccaattcctccactttgttcttatgcatttcagtagcaaggactcggaagatggagcaacatnaaatttaagctacaccgacaaacatggagt

SEQ ID NO: 57597 - DNA, 101 bp, rice(Oryza sativa)
  misc_feature (71): n=a or g
tcctttaggcacaatttccataggatcatggaccatattacgactctcaatgtctgtacgtaaactttgcnctagcacatgaccacataaagacaaatctg

SEQ ID NO: 57598 - DNA, 101 bp, rice(Oryza sativa)
  misc_feature (71): n=a or c
gtatcatgcatgtagcatgcgacagttcactcgtttatgttttttcatgccccaggttacgacatttgctnaaaaatgtataatataaaacggatggagta

SEQ ID NO: 57599 - DNA, 101 bp, rice(Oryza sativa)
  misc_feature (71): n=t or g
taattcagcaagcaaagttctggtaatcgtcgtgccgatagtggccgttgcaatcgtagctgcaacttccntttgtatatggaatgtgcgtaggaaaagaa

SEQ ID NO: 57600 - DNA, 101 bp, rice(Oryza sativa)
  misc_feature (71): n=a or g
agccgagcggcgaggcagcgttgcgagggtttgaagagggtggagcagcgacggcaaggtgaaaatcggcncggcggtgcggttgaggagcggcgccgtgg

SEQ ID NO: 57601 - DNA, 101 bp, rice(Oryza sativa)
  misc_feature (71): n=t or c
agttggtttgcagaaccaaatggaagttacccattagctaacctgccctaggtatgaacaataaacactanaaaaactctctaggattcttttgatttaac

SEQ ID NO: 57602 - DNA, 101 bp, rice(Oryza sativa)
  misc_feature (71): n=a or g
gcttcttgatgttgtttgcaccaaaaactttgaaagtccacttgacaagcttgggtttaaggaggatgctnctttggtcaagaggtattttcagtggtgaa

SEQ ID NO: 57603 - DNA, 101 bp, rice(Oryza sativa)
  misc_feature (71): n=t or c
ctaggaatcttgtgtgtgcttgaaagtcctcaagactctccataatggacatctgcgagataagactaccntgtagcaaccagaagaaaaaaaaggggatg

SEQ ID NO: 57604 - DNA, 101 bp, rice(Oryza sativa)
  misc_feature (71): n=t or c
gccgaccgtctctcttttcctctcttcttcttgaggcaggtttgccttgtatgttcatcgcgatcagtcanccacatgcaaagaacacctctctttttttc

SEQ ID NO: 57605 - DNA, 101 bp, rice(Oryza sativa)
  misc_feature (71): n=t or c
tgtgccacaatgattctgggatttgacatgtgcagatgaaaattccttggtcttagtttactgtatgacantgagagcgaaataagtacaaacaagcagaa

SEQ ID NO: 57606 - DNA, 101 bp, rice(Oryza sativa)
  misc_feature (71): n=a or c
tctcggtacaaggaatacctcgtggattattacaatcgcaaccaaaagaaacccaatgctgctgctgctgntgatctcactggagacgacgatagcctgac

SEQ ID NO: 57607 - DNA, 101 bp, rice(Oryza sativa)
  misc_feature (71): n=a or g
acaccaccaactttcagaagcgagagataaggatcgaactggtgatcaccagatgcagtatcaataatgangtgaagggaacttttcagtgactgcaacaa

SEQ ID NO: 57608 - DNA, 101 bp, rice(Oryza sativa)
  misc_feature (71): n=t or g
acatcttgaggggtatcattcagattcacaccatggagtggggaatgcttttgatattgaggttctcctgnaaactttgaagaacgttggttatgataatg

SEQ ID NO: 57609 - DNA, 101 bp, rice(Oryza sativa)
  misc_feature (71): n=a or c
tcttctagattcttttctgtgcaacttccctaaagcccaacacgctcagtatcaaaatctggtgatctctntgagtttcacagaacagatgacacattgac

SEQ ID NO: 57610 - DNA, 101 bp, rice(Oryza sativa)
  misc_feature (71): n=a or g
ctcgtctccaggatgtactgcggaaacgaagcaccgagtcagccagtcaggcaaggtcagccacggcggcngaggttttccggcgaggaggggatggccgg

SEQ ID NO: 57611 - DNA, 101 bp, rice(Oryza sativa)
  misc_feature (71): n=t or c
cttgttttgacaatatactacctaatgatcctatagaaataatcaggcaggtggctaactgtatgtctgantgggcaattttacagaccaaggaggaagaa

SEQ ID NO: 57612 - DNA, 101 bp, rice(Oryza sativa)
  misc_feature (71): n=a or g
ttttatacaacaaacccttcaatccttaccaatctagtttgctgagatgcagtagtacttgtggcaccgcnatgaagataccctatatgaatcaaggttgt

SEQ ID NO: 57613 - DNA, 101 bp, rice(Oryza sativa)
  misc_feature (71): n=t or c
tgactccttctgcgtttatctttctgtatgagatgcagctgttcctgaccttccgtagtagatcagtatcngtttggaatttccgtggtgaattagtcaca

SEQ ID NO: 57614 - DNA, 101 bp, rice(Oryza sativa)
  misc_feature (71): n=a or g
gtggacgattcaaatccaatattctctaatggagaaaaacagtacagaagcattctctaatgagaaaaacntagaacagatgttaattataagcaatctct

SEQ ID NO: 57615 - DNA, 101 bp, rice(Oryza sativa)
  misc_feature (71): n=t or c
aatcagttacaaaactgtagtataatattatattcactaaactgaaaaccatgaatattaagcaacgcctntcatagcctttgaaattgtgttttttccat

SEQ ID NO: 57616 - DNA, 101 bp, rice(Oryza sativa)
  misc_feature (71): n=a or c
cctgaatggcagctcccatggcaacagcctcatcaggattgacacccttgcttggtgtcttgttgaatatntgagaaacaatatcctgaacctttggcacc

SEQ ID NO: 57617 - DNA, 101 bp, rice(Oryza sativa)
  misc_feature (71): n=a or g
attttgcaaaaagtatagcccgagtcaaagaagtgaggagcaatcatagccgtatgtacaagatgcaatgntgaagatagcagtttccaaatattcaaagt

SEQ ID NO: 57618 - DNA, 101 bp, rice(Oryza sativa)
  misc_feature (71): n=t or c
ggaagctcgcaggtgcgaggttacgtgtactactgcccggacaagaaggtcagcctgcacccttgctgcgnagatctcccccgcgtgataaccaccgagac

SEQ ID NO: 57619 - DNA, 101 bp, rice(Oryza sativa)
  misc_feature (71): n=a or c
aaaattacattaaaaaataaacttgcggatttagttcatactcgtcgttgcttgggcacggagtttcgtanaggggacaactagattggctattaaacaaa

SEQ ID NO: 57620 - DNA, 101 bp, rice(Oryza sativa)
  misc_feature (71): n=a or g
gggcctgggttgcgggaacggtattgatgatcgattcacccttgccttgtcgaaatcagagtccaccacancgttactgtttgcttgaccgtctttgggtc

SEQ ID NO: 57621 - DNA, 101 bp, rice(Oryza sativa)
  misc_feature (71): n=a or g
atgcttgcttaccaaattcgattaccaccaaaccagttaattatcagcaggcaatgcaggacgcaatgttntctgcaacaatagaagaaagggagcacatg

SEQ ID NO: 57622 - DNA, 101 bp, rice(Oryza sativa)
  misc_feature (71): n=a or c
tccttaacgccttctgattgctttcaatgtccatcgacccatgtttccgattgaactctcgcaaggagtgnttcaccaactcgttgtcgaaatccgctccg

SEQ ID NO: 57623 - DNA, 101 bp, rice(Oryza sativa)
  misc_feature (71): n=t or c
cggttcgctttgcggagcagcgtacacttggacgggtgattctccacgtcattgtccatcctcgagttctnccacagcagtgccgacggcaggaggtgcga

SEQ ID NO: 57624 - DNA, 101 bp, rice(Oryza sativa)
  misc_feature (71): n=t or c
aacagcctaatggcacaaacatgagtgcataagtttgccaagttatgtgcgccccgacaaaatgaaaagcntagggctttcaagtactagtagaattagca

SEQ ID NO: 57625 - DNA, 101 bp, rice(Oryza sativa)
  misc_feature (71): n=t or c
gatctcagtcaacactcaacccaacatgattcagcgaccgaaattcctggtcacgaaagactgaaagaggnacattaattagtacaaaatttatgccatat

SEQ ID NO: 57626 - DNA, 101 bp, rice(Oryza sativa)
  misc_feature (71): n=a or g
tagccgcaatatatacattaaaaaatgagtcagcaactcaataattttggtagagtgattggcaactgctncacaataagaaatgtccaggggtcttccgg

SEQ ID NO: 57627 - DNA, 101 bp, rice(Oryza sativa)
  misc_feature (71): n=t or c
tagggcctaccattgttggatctgctcgtcccaggtccaccgtcgttggttccagtagtcgcgggtccgcnatcgtcaccaaagaaggagctgaggtacga

SEQ ID NO: 57628 - DNA, 101 bp, rice(Oryza sativa)
  misc_feature (71): n=t or c
catgcccggtcaaatttcaaacgggacactataaattctcctttgagcattacttgtactccctccgtccnataatataaaggattttaaatttttgctta

SEQ ID NO: 57629 - DNA, 101 bp, rice(Oryza sativa)
  misc_feature (71): n=a or g
aaccagacgaagtcatttgggggtcattactcaatgcctgtagaatacacagacacctagaactggccgancatgctataagaaacttgttggatttgaat

SEQ ID NO: 57630 - DNA, 101 bp, rice(Oryza sativa)
  misc_feature (71): n=t or c
atctctatagtttctagtagtaataaagtttaggagcttctatcctgtagacttcctggagttctgggtangtttctagtactttcctcattttataagac

SEQ ID NO: 57631 - DNA, 101 bp, rice(Oryza sativa)
  misc_feature (71): n=t or c
taacgaacaccatacatgtgagatcttacaattgatcgaggtgaagtcacactgaaggcttctggcatganagtttctactggggtaggcaatatgtgaga

SEQ ID NO: 57632 - DNA, 101 bp, rice(Oryza sativa)
  misc_feature (71): n=a or g
tcagacagccatgagattgaccatactttgctttgtcgagttgtttatttttttttcttgtaacccatcgnaattttactgttttggtttgtctactatat

SEQ ID NO: 57633 - DNA, 101 bp, rice(Oryza sativa)
  misc_feature (71): n=t or g
ctacaacatttcatgggtgtcgccagctaagggtattaaaatttcagatgagaacactttctatgttgtcngttgtaattttgatgccaccttgttcgagt

SEQ ID NO: 57634 - DNA, 101 bp, rice(Oryza sativa)
  misc_feature (71): n=t or c
aaaaacctctgttgttcagttgcaagtaatctagcactatcataattcgttatataattattggatcgcangtattcatttccgaaaagttcaataacttc

SEQ ID NO: 57635 - DNA, 101 bp, rice(Oryza sativa)
  misc_feature (71): n=t or c
tcagtgggaatcagggagttgagatcatcggtagagctaacactgaggattggtacctcatgacctgaacngtcattgcgaggcagcagattgagaccaag

SEQ ID NO: 57636 - DNA, 101 bp, rice(Oryza sativa)
  misc_feature (71): n=t or c
gttgtatagcagccccactcgtggtttactgtgaaatgctataatatgaacaagttgtatattgtagcagnagactcattttattgtgcgcttcggatttt

SEQ ID NO: 57637 - DNA, 101 bp, rice(Oryza sativa)
  misc_feature (71): n=a or g
taagcttggtgacttcgggttagcaaggcttgttgagcatgggggagagccacaaacaacacaagttgtcncagggacccctggatacattgacccagaat

SEQ ID NO: 57638 - DNA, 101 bp, rice(Oryza sativa)
  misc_feature (71): n=a or c
cggcgcacgaggtacggggtggagaacctcctagcaaacgcaaatggtggaggcaacaacaactccggcgntcccagagaccatccagtttctctcccccg

SEQ ID NO: 57639 - DNA, 101 bp, rice(Oryza sativa)
  misc_feature (71): n=t or c
attttagacccacgaggaaaccggaaagtgctcataggtgttggttttagcaaaaccggcacctacaaccngtcccttattaaaggttatgtaatagtggg

SEQ ID NO: 57640 - DNA, 101 bp, rice(Oryza sativa)
  misc_feature (71): n=a or g
ctcaagaaaggaggaggagaagaagaaggagaacatgagaagacgaagcagcagcagcagcctccaaaatnctagccggggaggcaggaagccggatgatg

SEQ ID NO: 57641 - DNA, 101 bp, rice(Oryza sativa)
  misc_feature (71): n=t or c
gacggaagatcttcaggcatcggaatatgcatttgctgataatgagaatttccatgggatcatctgattcngaacgcagctccaggtctagcaatgcaggc

SEQ ID NO: 57642 - DNA, 101 bp, rice(Oryza sativa)
  misc_feature (71): n=t or c
gccggtttgggctactgtgcagtgcaatcgtggattcaaatctgtctacatttattggtgtaggatgggtngcatctagttttatgtttgtttttttaacg

SEQ ID NO: 57643 - DNA, 101 bp, rice(Oryza sativa)
  misc_feature (71): n=t or c
ccttggataaggtgatttgggtgacgattgacttgtactccctcttccctctgtccaaaaaaaaaaaaaanaaacccaactataaaaaatttttatataag

SEQ ID NO: 57644 - DNA, 101 bp, rice(Oryza sativa)
  misc_feature (71): n=t or c
gtgcaagtgtgcattgcagatcgatatcagatagccgtaactaggggaagaaaacgggtggaaacggtatnattattttattatttttacaaaaacgatcg

SEQ ID NO: 57645 - DNA, 101 bp, rice(Oryza sativa)
  misc_feature (71): n=a or g
attcgttcacgatgatgggtcaggaaagatcgaagaacatgtgatctttcaggagacacttgatataaccnaatatatggacaccaggtattaatacttct

SEQ ID NO: 57646 - DNA, 101 bp, rice(Oryza sativa)
  misc_feature (71): n=a or g
gtggtggctgtgcctcgctctcctctcctcgcccccatcgactagtaggattttactttgaccttttcccnctcgtttgtactactaaatactccactcca

SEQ ID NO: 57647 - DNA, 101 bp, rice(Oryza sativa)
  misc_feature (71): n=a or g
ggcaaaactacctgacaaataaatatattattttaccaaaaatgctaacatgtacttactgcgtcccatanaaaataaatttagcaccagatgtaacatat

SEQ ID NO: 57648 - DNA, 101 bp, rice(Oryza sativa)
  misc_feature (71): n=a or c
tctcaagagtttccttttgtagacaatgaattgattcaatttagagaaaacaaggaaattggtgataaaantctactacagtttgttcaaaatgcactagt

SEQ ID NO: 57649 - DNA, 101 bp, rice(Oryza sativa)
  misc_feature (71): n=a or g
tagctattctcacttcacacatactattttatttttacaaagtgtacattaaatttgggttggcatatttntagattgatattgatctttttaacaatttt

SEQ ID NO: 57650 - DNA, 101 bp, rice(Oryza sativa)
  misc_feature (71): n=a or g
ggcatcttatgaggactgccaacatagcttctgccaatgaactcatcatggatagtactgttctggggggnctgctgcacagttaatggcatcgtatagga

SEQ ID NO: 57651 - DNA, 101 bp, rice(Oryza sativa)
  misc_feature (71): n=t or c
gcatatggtgggttgaactatttgagccaaaattctttgtgaatatgggcatgaattagtatctctaaccnatctaaggctttccaaatgtcaaacttcat

SEQ ID NO: 57652 - DNA, 101 bp, rice(Oryza sativa)
  misc_feature (71): n=t or g
aggtaatcttactagttttattgattacgtacactgcttgactttgatgaagccggattgactacaaaagnaatgtgacacagaaacatttataaaacagg

SEQ ID NO: 57653 - DNA, 101 bp, rice(Oryza sativa)
  misc_feature (71): n=t or c
ggagtcagaatatgacgtgtgtccagtcgagcaagataatttcctgaatcatgtcacatatggtttgtcanctgaccacctgactgatactgattcctcta

SEQ ID NO: 57654 - DNA, 101 bp, rice(Oryza sativa)
  misc_feature (71): n=a or c
ttcatatagtattttatatagttacatattctcagaaataagaatggattcttgggaggagctaaagattntgagagaaattaaatgcaaccactaaaaac

SEQ ID NO: 57655 - DNA, 101 bp, rice(Oryza sativa)
  misc_feature (71): n=a or g
actggcacagtgactccagctcaactgaaaaactttgctctatgtcttcacctccaggatgttcacacacntatttcaagcattgtgtcaacacttccaaa

SEQ ID NO: 57656 - DNA, 101 bp, rice(Oryza sativa)
  misc_feature (71): n=a or g
taatggtggaatcgaagctaacaatctgcaaatttcttttgaatctgtagggccaacgtggctgtgcgacnggaactccacactcctgcttctgatcgttc

SEQ ID NO: 57657 - DNA, 101 bp, rice(Oryza sativa)
  misc_feature (71): n=a or c
ttgactagttccacatcatggaatcttgaagccaacagtaaagtaatcacatagaagtaaactgtagatcnatcacatggaaataaactgtgaactaatca

SEQ ID NO: 57658 - DNA, 101 bp, rice(Oryza sativa)
  misc_feature (71): n=t or g
tatctggatggatacatctgagagtttgtcatcagaagcctgagtgaagacaggtgtagtcattgcaatcntttctgaagaagcattcttgccaaaaatat

SEQ ID NO: 57659 - DNA, 101 bp, rice(Oryza sativa)
  misc_feature (71): n=a or c
gtcctcttaattattattatcgcgatagggctagctagctcagctgccatcttgttcttcctgcagtatgnatgcatgcaatgcaattctagtatttgggc

SEQ ID NO: 57660 - DNA, 101 bp, rice(Oryza sativa)
  misc_feature (71): n=a or g
tgctactgctgagttaatttgggttcagtcagttcttgaagaattaggagtaaagattgctcaatcgcctntgttatggtgtgacaatttaggggcaacat

SEQ ID NO: 57661 - DNA, 101 bp, rice(Oryza sativa)
  misc_feature (71): n=t or c
tcctcggtttgataagtacctccaaaatatgcaagaaacgacaaaactcttgaagtctaaagtaaatcganggtccgaacgttgttttatccattttattt

SEQ ID NO: 57662 - DNA, 101 bp, rice(Oryza sativa)
  misc_feature (71): n=t or g
tgagcaatgacatgaggcaggtcgaagttaacgccggtgatgttcttgtacctcgaagtgatcatctccanggtggcgccggtgcccccgccgacgtcgac

SEQ ID NO: 57663 - DNA, 101 bp, rice(Oryza sativa)
  misc_feature (71): n=t or g
acaagtgttttaactctttggtgcttaaggacacagtgtcctggaattctatgctgactggatattcacancacggtttgagtgccgatgccttgaagttc

SEQ ID NO: 57664 - DNA, 101 bp, rice(Oryza sativa)
  misc_feature (71): n=t or g
gatttcatttgcatgttgcaggttcgcaaatacgaccaagcctgtttcagtctactcggatcagactctcnctgatgcattgcatattctttcaaaggaga

SEQ ID NO: 57665 - DNA, 101 bp, rice(Oryza sativa)
  misc_feature (71): n=t or c
tttttggtggaaacgctccatgtttgggcagctgttcctataaggtaacccagctgttcttgtgggactgnctgtacatttgtcgacaaatttttcctcaa

SEQ ID NO: 57666 - DNA, 101 bp, rice(Oryza sativa)
  misc_feature (71): n=a or g
cctgcaaaaaagctgctcaattttatttatccttcattgtacagggttgatgaagtattgtcaatggtatnttatatttccttcatatacatcttgttaag

SEQ ID NO: 57667 - DNA, 101 bp, rice(Oryza sativa)
  misc_feature (71): n=t or g
atgcaggtgttctcatggcaagcttcaatccaagctcaacaacggaaaatcttcagcacaagccaaaacgnagcaaagcagagatggattatcatcaagtg

SEQ ID NO: 57668 - DNA, 101 bp, rice(Oryza sativa)
  misc_feature (71): n=a or c
gatgatgacggtgaggagtcgggatgggagtcggactcatccgtggcatcatgtcctgccacattgtcatntgaggagcgtcggcaaagacctctcgggtc

SEQ ID NO: 57669 - DNA, 101 bp, rice(Oryza sativa)
  misc_feature (71): n=a or g
gccaacgacaatggcgcggtgcccatgatggagacaacatcaactctctccctctctgcctcattggctgncggcgccttgaagacgggtggacgccctct

SEQ ID NO: 57670 - DNA, 101 bp, rice(Oryza sativa)
  misc_feature (71): n=a or g
tcgcactcggcgcgcgcgcggtggcacaggaggagcaaggaggccaagagtggcaagcacaacaaggtcgngtgcatcttgccgctcgtggagctagctgc

SEQ ID NO: 57671 - DNA, 101 bp, rice(Oryza sativa)
  misc_feature (71): n=a or g
tcatcttgccaatctccagaagatgcaagtccttaatcttagcttcaatacactggatgggattattccanacaccctcacaaactgttccaacatgagga

SEQ ID NO: 57672 - DNA, 101 bp, rice(Oryza sativa)
  misc_feature (71): n=t or c
aatgcaatcctagctgctggatgatgatgtacagaggatcgatgcatcatgcatggcatggagcattactnctgttgcgcaccgccgccgcgcgtgccggg

SEQ ID NO: 57673 - DNA, 101 bp, rice(Oryza sativa)
  misc_feature (71): n=a or c
aagcaatgccagaatgcgtagtgatagtggtggaaattctggagcaaatgtgcataggagagctgatttgnaaggacctaccggtaggtttgtttctcaaa

SEQ ID NO: 57674 - DNA, 101 bp, rice(Oryza sativa)
  misc_feature (71): n=t or c
gtgacgaagaaagttgtacaattcactttatatttaaaaaaaataattgacggagattgacacgcacctcngttgcgggaagatcttgggcccgttctcga

SEQ ID NO: 57675 - DNA, 101 bp, rice(Oryza sativa)
  misc_feature (71): n=a or g
aggaggtcaagtaaacccaaggatgataaattatacatcagcaatgaaaagcaagatgcaagcttgtgccngcaatcccttgagtccgttcatttgcatgg

SEQ ID NO: 57676 - DNA, 101 bp, rice(Oryza sativa)
  misc_feature (71): n=t or g
tttttcttctgttccagtgcaatctcagaggccttcaccagcttttatgccagtgagacctcctatttccntgtctcctcttgtttcaagtccacagctgg

SEQ ID NO: 57677 - DNA, 101 bp, rice(Oryza sativa)
  misc_feature (71): n=a or g
taatgttgttgtgcccacagctacaagtattatagccagagcatttgggcgagagatagttaatggtgctnatctttttgatcacgggaccctgattagag

SEQ ID NO: 57678 - DNA, 101 bp, rice(Oryza sativa)
  misc_feature (71): n=t or c
tatgtagtactccatctttgatcgatgtaactagtgaagagttactaggtgttgttgttgatgcatggtcnaaatgacggacagcagccacccatggtgag

SEQ ID NO: 57679 - DNA, 101 bp, rice(Oryza sativa)
  misc_feature (71): n=t or g
gttaccatgactggcctgctgctgttcattttcgtcagttaccctcatattgggcaatggtcataggctgngtttagtcagcgcaaagtttggattttggt

SEQ ID NO: 57680 - DNA, 101 bp, rice(Oryza sativa)
  misc_feature (71): n=t or c
ctgccgtagcctcgccactcagactgcgcgcacacctgcagttagattaaaaccttggggagactaaaatnaaggaaaagcaaaagaaaactgaaaagaaa

SEQ ID NO: 57681 - DNA, 101 bp, rice(Oryza sativa)
  misc_feature (71): n=t or c
aaccggtcagccatgtggagatcaaaaccaagctaattactgctgctgctgcatgctgaatgcagtaagangtactccgttgtctcctacgtaataataca

SEQ ID NO: 57682 - DNA, 101 bp, rice(Oryza sativa)
  misc_feature (71): n=t or c
gcggtctaaaattttcagctataacaatatagtgaaccaaaaacactattagagatcatcacaaaagacanggcactataggtaccagaaatactaaaacc

SEQ ID NO: 57683 - DNA, 101 bp, rice(Oryza sativa)
  misc_feature (71): n=t or c
cctcgctgcagctcacagcctcctcgatctcctctacagcagctcactcactgctcaacaatggcgacggngaggttgatcctcctgctcacggtggcggc

SEQ ID NO: 57684 - DNA, 101 bp, rice(Oryza sativa)
  misc_feature (71): n=a or g
atcaatatattatacagtaaaagttctcaaaagttaacattctcgtgagagcaattttacggtccttgagnaggtaccatgaggtaccaaaaatttagtgt

SEQ ID NO: 57685 - DNA, 101 bp, rice(Oryza sativa)
  misc_feature (71): n=a or g
taccatcccctgtctattgggccttgttgggccaaagctgatgcactatccctgcctatataaacctattnctaaaccctaaaatcggtagaagctgccac

SEQ ID NO: 57686 - DNA, 101 bp, rice(Oryza sativa)
  misc_feature (71): n=t or c
gagcaaccgattttcccacctccccccggtcgaccgatacagagcattatcggaataatacttcggatttngattggacataccacccatacccatcgggt

SEQ ID NO: 57687 - DNA, 101 bp, rice(Oryza sativa)
  misc_feature (71): n=a or g
aagccgatggtagcgacgaccaaagcgagatggactgcaagataaagcatcaagccgcatacttaacaagngcctctcaaaggtggaggttaaagcaaacc

SEQ ID NO: 57688 - DNA, 101 bp, rice(Oryza sativa)
  misc_feature (71): n=t or c
gtgtcggtggtgccacgcggcaacctgctgccacgtactgtgtttccgttgggttcttctggacactttgntatctgtgtgggggagatgaccgcgcgtgc

SEQ ID NO: 57689 - DNA, 101 bp, rice(Oryza sativa)
  misc_feature (71): n=a or g
aacgacgaatagggagggtagggaagctgggggatgcccagccaaggagagcatcgtaaggatcgatctcnctggatcgcgtggagaggagcgacaccgat

SEQ ID NO: 57690 - DNA, 101 bp, rice(Oryza sativa)
  misc_feature (71): n=t or c
gaagtatcatctatgcctaacaagttaaatggcttcatctttaaacaaataggctgtgttcttttctcccntttcccaactcacttccctcgatttccacg

SEQ ID NO: 57691 - DNA, 101 bp, rice(Oryza sativa)
  misc_feature (71): n=t or g
tggaataatgttggaacacgaattgtatcctgctgacaaagaaacaaaagcagtcctgttttgttctgccntgagacgagaggagagggttatcaaccata

SEQ ID NO: 57692 - DNA, 101 bp, rice(Oryza sativa)
  misc_feature (71): n=t or c
ggtgtggagtatgggagggggaaagtgaaaaatattgcgatgacacgtaaatcgataagaattattattantagagtatgattaattaggtattagaatat

SEQ ID NO: 57693 - DNA, 101 bp, rice(Oryza sativa)
  misc_feature (71): n=a or g
cagttcgttacatgcaaaataagataaccaagtgcattcaatcacaacgaactggctcagcagagccaacncttcgggcaaactcaaggtaatcccctcac

SEQ ID NO: 57694 - DNA, 101 bp, rice(Oryza sativa)
  misc_feature (71): n=a or c
ttcacttatttttttatcgtttattagttgtagcttaacctactagaggcttagaacgtagaagtttgtgnaaattttagaggattctttaaagttttttt

SEQ ID NO: 57695 - DNA, 101 bp, rice(Oryza sativa)
  misc_feature (71): n=t or g
acttatcagcaaagaaatgaaatggatggacggtgatcacgtgttgaccagacctgacacaaactcacatncattactgttacgcgtctccacgtgcctcc

SEQ ID NO: 57696 - DNA, 101 bp, rice(Oryza sativa)
  misc_feature (71): n=a or g
acgcgatagcaagagagaaaaggtagatcttgacatctctggtggagatcttactatttcccgccatcacncacacatattctatgattttgaatgcaagc

SEQ ID NO: 57697 - DNA, 101 bp, rice(Oryza sativa)
  misc_feature (71): n=a or g
ttgaaaacataggtccatatgacacggcccatttcagtcgataagttttgaacaaacggtttcgtagtcancggttgactgaggctttagtttttttttaa

SEQ ID NO: 57698 - DNA, 101 bp, rice(Oryza sativa)
  misc_feature (71): n=t or c
aaaatagtcgttactactcatcactgacctgtacccttgttgatccagggggagatgacgatggctggganacggacgccgaggcgatcaaaggcgaagtt

SEQ ID NO: 57699 - DNA, 101 bp, rice(Oryza sativa)
  misc_feature (71): n=t or c
ctgatcatgttcttcctgatttatcaaattctgttctcgatctgcaggcttgagtagcgctaccgtggagngccgcgtcggccaattgatgattagcggcc

SEQ ID NO: 57700 - DNA, 101 bp, rice(Oryza sativa)
  misc_feature (71): n=a or g
aggtatacctacagactaggtcataggctaccaaacagtacacttatctggagcaagtcatacagcttcanagcatcaccttatcctggacaagattcttt

SEQ ID NO: 57701 - DNA, 101 bp, rice(Oryza sativa)
  misc_feature (71): n=a or g
taaatacctctccaatagggtcaagaagaaagtattctcgcaacacgcaagattgagagacatgcaccatnagtatctcttgctattggtaccacctcctc

SEQ ID NO: 57702 - DNA, 101 bp, rice(Oryza sativa)
  misc_feature (71): n=a or c
aaggaaagactattgaacaaaacaaacgtggttttgagcaactgtttctgcacaatgaatttttgatcacntctcttaaataacgtacaaagctttttcca

SEQ ID NO: 57703 - DNA, 101 bp, rice(Oryza sativa)
  misc_feature (71): n=a or g
gatcctgcaggtaaaagcagctgaagatgctaaagcaatcttttctgatctaagaaagaaagggatatctnttatttggagttggaggttactgttggggt

SEQ ID NO: 57704 - DNA, 101 bp, rice(Oryza sativa)
  misc_feature (71): n=t or c
gccatggcccgaggcctaggcctaacgctggatgggctcacagcgatcttccccatcatgccaagtcctanatgtgttggtgcaaggcttggcgcgcactt

SEQ ID NO: 57705 - DNA, 101 bp, rice(Oryza sativa)
  misc_feature (71): n=a or c
cgcaacctcgattagcttttgttctgcgcactcccggagataatgaaatttgatgtcaacatgcttcgtcnggtcgtgatgcacaggattcttgacaagag

SEQ ID NO: 57706 - DNA, 101 bp, rice(Oryza sativa)
  misc_feature (71): n=a or g
aaacgcgtgtgccccgtgcacgcacgaacaccttcccacaaaagccactggtgtatggttagggtttggtntggggttgaggagaagggtgtgtgctgagg

SEQ ID NO: 57707 - DNA, 101 bp, rice(Oryza sativa)
  misc_feature (71): n=a or g
gtcacctggtggtcgggtatggcttcaagtacaaggtccaacagcatgactatcgcaacaacattgtgccntggggcgacgaacattgtggtcgtcgtggc

SEQ ID NO: 57708 - DNA, 101 bp, rice(Oryza sativa)
  misc_feature (71): n=a or c
acccacacgttcaactgagctaccaacatgagaatctgaatccctgaatgtgccagcaattctcacatggntgcaacagtaatggcttccctccgatatag

SEQ ID NO: 57709 - DNA, 101 bp, rice(Oryza sativa)
  misc_feature (71): n=a or g
ggtcttggtgataaaaataatgtgtaatatttggaaaggatatgaagtaccacatattttatcgacgagantggtactcccaagatccacagcaaaattaa

SEQ ID NO: 57710 - DNA, 101 bp, rice(Oryza sativa)
  misc_feature (71): n=a or g
ctgcaaccacatctcctgatacgtatgtcacgcaaagtgtgtaggttaattaggttaccaatcccatttgntgcacactctagctctttaagatagtcaac

SEQ ID NO: 57711 - DNA, 101 bp, rice(Oryza sativa)
  misc_feature (71): n=t or c
agacatgctggcatatacggggtgctactccattattattcatcgaggagtggtaagtactaaattaacantgacaaaattgaataaaccaccaaattatc

SEQ ID NO: 57712 - DNA, 101 bp, rice(Oryza sativa)
  misc_feature (71): n=t or c
actagtgacaacgatggtcctgttccgatttctgttttcctggttgctagtgttctgaaggagaacagtgngaagctcctgcaggaagctcgagggattga

SEQ ID NO: 57713 - DNA, 101 bp, rice(Oryza sativa)
  misc_feature (71): n=a or g
aaatccttccaagatgctttcagggaggctcagcatttgcgactgctgcatatcactgcagcttatgctgntcttgattccttcctttccagtttggcgaa

SEQ ID NO: 57714 - DNA, 101 bp, rice(Oryza sativa)
  misc_feature (71): n=a or g
tcaacacaccggtcgggtattggtgcgcacctgaacaacacaatcatgtttctgatttggtcccggattcngagtcccggtttgcaacctaggatgattct

SEQ ID NO: 57715 - DNA, 101 bp, rice(Oryza sativa)
  misc_feature (71): n=a or g
gtctgaatctcacaggtggctcaagaatgtgtagaaaagagatcacgtgaaatgttatcactatatgaccnccaagaatcctcggaatcctacgtgaagat

SEQ ID NO: 57716 - DNA, 101 bp, rice(Oryza sativa)
  misc_feature (71): n=t or c
tacggtgtatcgtttcaaggatgagttcggatgagtgatcgatcactctccacatacttggatcggtctcnctcgcacacgtacaacgacaaggggagacg

SEQ ID NO: 57717 - DNA, 101 bp, rice(Oryza sativa)
  misc_feature (71): n=a or g
ctcaccgtgctcatccacggcggcagccgccagccagattggtttcctcatccatcatcccaattgcgccnccgagaccttaaaattaccttgttcaccat

SEQ ID NO: 57718 - DNA, 101 bp, rice(Oryza sativa)
  misc_feature (71): n=t or c
ggatttattggcaacgaggctggcggcctaacgatggcaagcgagagttttagcggggaggtggcaatggntccgtttggttgggccttcctagcacagtg

SEQ ID NO: 57719 - DNA, 101 bp, rice(Oryza sativa)
  misc_feature (71): n=t or g
taattaaagaagagggcagtgtccaggggagtaggactaattaaggtcgtaaacttttaagtatgtatgtngatttctatgtctaaagtttgatcgttcgt

SEQ ID NO: 57720 - DNA, 101 bp, rice(Oryza sativa)
  misc_feature (71): n=a or g
caagtaatcaagccacgcctctactcatcgttcaatgtagcaacagagattaatttaaagcggaacccccnatgaattactattcgttaactgatgtgcct

SEQ ID NO: 57721 - DNA, 101 bp, rice(Oryza sativa)
  misc_feature (71): n=t or c
aggctcagctatcaactccaaattcttagcttccaatagacctcccaggagcatgcatttggcactatcantgccagtctcatctatcatacaaagacaac

SEQ ID NO: 57722 - DNA, 101 bp, rice(Oryza sativa)
  misc_feature (71): n=a or g
cacggcttcggcgtcgaaatccgggagcaacagccggtgtttctgcaaattgcaactgttagctagagggnaattaatgattgcgacctgttggccaaact

SEQ ID NO: 57723 - DNA, 101 bp, rice(Oryza sativa)
  misc_feature (71): n=t or c
tgaagtctgtcagccatgatttttgctataaactttgtgcttatattctgtaaagagattggtctgaagtngtttgatgacttttttgggaccaagcagat

SEQ ID NO: 57724 - DNA, 101 bp, rice(Oryza sativa)
  misc_feature (71): n=t or g
agaacaagatacatgacgagggcgcgaaacccatcctggaggagcaggagaggattcgcaaggagtacaangagaaaggctatgccgagtactggatcacc

SEQ ID NO: 57725 - DNA, 101 bp, rice(Oryza sativa)
  misc_feature (71): n=t or c
tcagtttatatataagccttagctgaataaatcattcgccgagcaaccagttagctgtgtttagttccttncaaagttaaaaatttgggttaaaattagta

SEQ ID NO: 57726 - DNA, 101 bp, rice(Oryza sativa)
  misc_feature (71): n=t or g
ctcgagcagggttaagtgggcctgaactcaggttttgcaaagcccatcatgctcttatctgttgaattttntattcaatagaaaaatacacgaatatactt

SEQ ID NO: 57727 - DNA, 101 bp, rice(Oryza sativa)
  misc_feature (71): n=t or c
ttttcagcactgaaaactacacaccgcaattgcactcatggagaaacacatactggttctggctgggaacnagtcagaggtgccggtttcctagctaaaac

SEQ ID NO: 57728 - DNA, 101 bp, rice(Oryza sativa)
  misc_feature (71): n=a or g
tttgacatatcacaaaacaaaacgaaatgaacccctttgtcactttgattgcaagaagcagagagagaganagagagagagagagaccaattacaaataca

SEQ ID NO: 57729 - DNA, 101 bp, rice(Oryza sativa)
  misc_feature (71): n=a or g
aggggtgaaagaaagcggaaagtaatggccagtgtcgatacacatgatcatggaaacactgagttgcctgncagcaatgagaatgctgatgaatcactcag

SEQ ID NO: 57730 - DNA, 101 bp, rice(Oryza sativa)
  misc_feature (71): n=t or c
accaacgaccaactaattgaaccaaaatatgaaacggaagcccaacttaggccctgtttagatcatctggnaaaatttttcacccaatcacatcaaatatt

SEQ ID NO: 57731 - DNA, 101 bp, rice(Oryza sativa)
  misc_feature (71): n=t or c
atttggcaggctgatcaggtgaagccttcgtcaaattcagatgctgtggtgaagaaacgccatgcaatagnttgctggtcatgtgttgctgcacataagca

SEQ ID NO: 57732 - DNA, 101 bp, rice(Oryza sativa)
  misc_feature (71): n=a or g
aactgtgaatatactgaaggagcctatctttagtctaccagaattgcttactgcctttgcacaggggaagntctcagctgacagaatagtgtcatatctcc

SEQ ID NO: 57733 - DNA, 101 bp, rice(Oryza sativa)
  misc_feature (71): n=a or g
tgtcctacgtaatcgaggaccaaggagaatgcaatgcaccatgcactctataccggcattgtgtattcagnaaggtgggaaggccccaacccctaccggca

SEQ ID NO: 57734 - DNA, 101 bp, rice(Oryza sativa)
  misc_feature (71): n=t or g
tgaaggggttttggatccaaagatgactgagaagcctacttctagggcactgaagaaggctttgttagtanctctgcgatgtgtagacccagaagcccgta

SEQ ID NO: 57735 - DNA, 101 bp, rice(Oryza sativa)
  misc_feature (71): n=a or g
gatctccttttgactgctgcgtggggcccttttaaagactttaatcaatgtactgtaataagcgggtgtantttttttttgacatttttattaactttaat

SEQ ID NO: 57736 - DNA, 101 bp, rice(Oryza sativa)
  misc_feature (71): n=t or c
tgtcccgttggaaggaggtctccgatcaactgtagaagctcttatcactccaattgtttgttgatttcatntgtagcaacgagaggacaacatttaactcg

SEQ ID NO: 57737 - DNA, 101 bp, rice(Oryza sativa)
  misc_feature (71): n=t or c
aggcttgagtgcgtgtttttgtctccgtggctactgctgtactactgcaggagtactagtactgctactangctggccagccgcagcgtccatctttattt

SEQ ID NO: 57738 - DNA, 101 bp, rice(Oryza sativa)
  misc_feature (71): n=a or g
ctgataagtcaaaggaactgataagtcatcgccccctacaagcccaaacaggcaaaggtgtacgatgtggntcggagtgacatggtcgtggcttcgccgct

SEQ ID NO: 57739 - DNA, 101 bp, rice(Oryza sativa)
  misc_feature (71): n=t or c
ttcctaagatcctcccacaagatcaacactccaaaatgcccaatccttgtatcgcgctccaaccacccatncgtgcatccactctcttcgcgctccgtcgc

SEQ ID NO: 57740 - DNA, 101 bp, rice(Oryza sativa)
  misc_feature (71): n=a or g
tcatctgatagacttacaactagctagctttgcatgtccttcctcctgccagttgttttcttgtatatgtnacactacttaggctttatattggtctctct

SEQ ID NO: 57741 - DNA, 101 bp, rice(Oryza sativa)
  misc_feature (71): n=a or g
actggtccgataacactgcaccttgatcttgaggacagatgacctatctgggactttacttgatctccatnaagtgcaccatttcatcaaccggtccatca

SEQ ID NO: 57742 - DNA, 101 bp, rice(Oryza sativa)
  misc_feature (71): n=t or g
ccttcatatcatcaatttggtccataatttgatcatccagtggagtcatttcattgtcggccataggaagnctagtaatctcttcaccatctaagatattg

SEQ ID NO: 57743 - DNA, 101 bp, rice(Oryza sativa)
  misc_feature (71): n=a or g
gaggaaggcgacttgcaaggatgatacgatggtgcctgcggcaatgtatcatgatagcttgatttggaggntgatcgcactcggtgccaacgaacagtgct

SEQ ID NO: 57744 - DNA, 101 bp, rice(Oryza sativa)
  misc_feature (71): n=a or g
ttactccccaaaactattgtccacttgctgaatcacattcctattgattagttcctcaaagcaattattcnccactccgttaatactaagctcatcatctt

SEQ ID NO: 57745 - DNA, 101 bp, rice(Oryza sativa)
  misc_feature (71): n=t or g
tcatgaaatgagcagctgggatttccttcacttccccattaaggtctccagactccatgattttgcatgtntcctttacctccaataacacgtctaattcc

SEQ ID NO: 57746 - DNA, 101 bp, rice(Oryza sativa)
  misc_feature (71): n=a or g
ttgattgaggtaaatgtaaatagtatggtgcatttgtcagctattaacacttttggatctaaaatgaacangtgatatgataatgttatagggaatcactt

SEQ ID NO: 57747 - DNA, 101 bp, rice(Oryza sativa)
  misc_feature (71): n=a or g
tgtctttgaggttttttcattctaaccgttttgatcacctagcctcatggagaagagaaaaatcttcacangatggtgcgggcgaaagcggcgcacagtgg

SEQ ID NO: 57748 - DNA, 101 bp, rice(Oryza sativa)
  misc_feature (71): n=a or g
agaagatagatagatagatgatatatgatgtatgcggtgcatcgttgaatggatagataggttcagatatnatctgttgtaacagaatagatattatctat

SEQ ID NO: 57749 - DNA, 101 bp, rice(Oryza sativa)
  misc_feature (71): n=a or g
gagttacatttatttgcacattcattcttgcatatcactatcagtactcgtcgtaaaacaaaccggtatcnagatagaaattccaaaaaaaaaaaaaaact

SEQ ID NO: 57750 - DNA, 101 bp, rice(Oryza sativa)
  misc_feature (71): n=a or g
caaaagcaaatgcagatgatgaattagcagtggaaacctcataacaaaagaaccttggaagtgcacgtagngtgcaccattccagtactccgcacgtataa

SEQ ID NO: 57751 - DNA, 101 bp, rice(Oryza sativa)
  misc_feature (71): n=t or c
atttcggtcaactcatggctaaggaactcaatgttcttacgcattcccttgagtttcttgcacttgttgcngagcagcatggcaagtttggtgaggagtgg

SEQ ID NO: 57752 - DNA, 101 bp, rice(Oryza sativa)
  misc_feature (71): n=t or g
aagttgggtaacatatcgatatgccctctgattaaatagatggcgatgcatcgttaccattgagctaaganaaattttattatccttgagaaagtatctgg

SEQ ID NO: 57753 - DNA, 101 bp, rice(Oryza sativa)
  misc_feature (71): n=a or g
cagctccggtgccacactcctgaggttggcaacgcttaccgtattcaccaggccgttgattctcttcctcngggtgtcctagctgagacgctggtactcgg

SEQ ID NO: 57754 - DNA, 101 bp, rice(Oryza sativa)
  misc_feature (71): n=a or g
ccctaccggcggcggctcattttgtatgaccggcgcttcctttgggaggagctgcctaaaccttagcaacntcatatccggcatcgggatgctctctgtgc

SEQ ID NO: 57755 - DNA, 101 bp, rice(Oryza sativa)
  misc_feature (71): n=a or g
aaaacaaataatgtatagtaaataatttactatgcgagggcgtgttttagttatcgcgtaccgaggatgcnttttagcgcatccctctctatatatagcaa

SEQ ID NO: 57756 - DNA, 101 bp, rice(Oryza sativa)
  misc_feature (71): n=t or c
tttaagagatcaacatcttgcccactatcatatgagccagtgtttcttcttccggtgataatctctaatancaaaacgccgaagctgaacacgtccgattt

SEQ ID NO: 57757 - DNA, 101 bp, rice(Oryza sativa)
  misc_feature (71): n=a or c
gtactcagaaaatcgtaaccatcaccaaaccaccccaaacctcttttctggtggatccaaaccaatcttcngtccaaccaaagcacacccagatacaaaac

SEQ ID NO: 57758 - DNA, 101 bp, rice(Oryza sativa)
  misc_feature (71): n=a or g
aaacaggggaaacagcacgcggagaggatgtgtctggcgaatagatggagtgctgtacggttgcctcatgnagcatagggtcgagatggctctccaggagg

SEQ ID NO: 57759 - DNA, 101 bp, rice(Oryza sativa)
  misc_feature (71): n=t or c
gttctaatatttggcctattctaagttatgttattttggtacggatagagtaatagtgaaacctcactctntatgagtaagcagcagcagcacagatgata

SEQ ID NO: 57760 - DNA, 101 bp, rice(Oryza sativa)
  misc_feature (71): n=t or c
ccttcaccggcaaaagcatttgccggtgattgaatagttaaattaggtaggcctttcttgctggcttccangtaccatgtatgaaaccttctcatctccca

SEQ ID NO: 57761 - DNA, 101 bp, rice(Oryza sativa)
  misc_feature (71): n=a or g
tgatgaatctgggaagcccatctggaagaacagggtggagagctggaaggagaaaaagaaagagaagaaancctcagcaaagaaagctgcagcaaaagctc

SEQ ID NO: 57762 - DNA, 101 bp, rice(Oryza sativa)
  misc_feature (71): n=t or c
cattgtctatggttgtatatatgtcgcacatccttacatcattgtctatgggtgtaatacggacatttaantatttgtcatttttaagatgtggcaattaa

SEQ ID NO: 57763 - DNA, 101 bp, rice(Oryza sativa)
  misc_feature (71): n=a or c
acagtcactttttcgactaacacaacaagtgtatccagcttcagcccgaatgagagcatgatgaaggcgtncatcacctttgacagcaagacctcgatgct

SEQ ID NO: 57764 - DNA, 101 bp, rice(Oryza sativa)
  misc_feature (71): n=t or c
atttatgactaactattctttcagtcgtagctacatgacgcacccatcgacaacgaggtacttatgatganttcgtcaatctcaaaatatactgatccaat

SEQ ID NO: 57765 - DNA, 101 bp, rice(Oryza sativa)
  misc_feature (71): n=t or c
ggccacttaatttgatcccgatattctatttggtgcaaggcagtcctctaagagtacccacaatggttatntataggctctctacaagagatccatgtcag

SEQ ID NO: 57766 - DNA, 101 bp, rice(Oryza sativa)
  misc_feature (71): n=t or c
ttttaggcctctcttggctccgagcgagacttatgttagtggaactcaaaatcttacatacatacatacanatacatacacacacatatatatatatatat

SEQ ID NO: 57767 - DNA, 101 bp, rice(Oryza sativa)
  misc_feature (71): n=t or c
tctagaaatgtgctaaccatcattggttgggacgaacgagttatgtttgtagatgttggttggcctggttnagtacacgaccaaagagttctatcggaggc

SEQ ID NO: 57768 - DNA, 101 bp, rice(Oryza sativa)
  misc_feature (71): n=t or c
acgatgatcagttctgcgagttcaagttcttcaagctggatatagcaatggcgccgtcgccattggacgcnggcgatctggatgggttcagctggttcctc

SEQ ID NO: 57769 - DNA, 101 bp, rice(Oryza sativa)
  misc_feature (71): n=a or g
tgacctgccaactcaccttcggcatcagattaatatcagaaagacggctcggcggcgggagctgccacagnagcagcaccagcacaaactacggtggacgc

SEQ ID NO: 57770 - DNA, 101 bp, rice(Oryza sativa)
  misc_feature (71): n=a or g
ccctcgaaggatatatagatgtccctagttgacatgcatatgctgcaagttgtttcaatgaagtctgatgnatcgtacatctagtagcatataaaagtccc

SEQ ID NO: 57771 - DNA, 101 bp, rice(Oryza sativa)
  misc_feature (71): n=t or c
tggacaccaagcggatcttacacagcaaaatcagcctatcaaatgcagatcttgggcggcataccgtccanatcgacaaacgtgatatggaaatgctgggc

SEQ ID NO: 57772 - DNA, 101 bp, rice(Oryza sativa)
  misc_feature (71): n=t or c
cttaacccccgcaattaacgcggattaatctcgccgcgaccacaacaacttcctctctgtttcactacccnctctctctctctctctctctctctacacgc

SEQ ID NO: 57773 - DNA, 101 bp, rice(Oryza sativa)
  misc_feature (71): n=t or c
ctcgctcttctcgatacatccgagtgatagactttaaaggtatggaaaacatgccttacaatgttctgatngtgccttgggattacaactgataagtaaat

SEQ ID NO: 57774 - DNA, 101 bp, rice(Oryza sativa)
  misc_feature (71): n=a or g
tgtgaggatgagccgagcagttgggtgcggatcgttgcgccgttggatttagcgaactggctcatactccncgtgtctgtcagggttggagtcaccgccac

SEQ ID NO: 57775 - DNA, 101 bp, rice(Oryza sativa)
  misc_feature (71): n=a or c
tggcccccctcatgcctaaatcctggcttcaccactgtcaggctaccttcaggcattactttttctcatgnagataacagtcaccaaacatgtcctaagta

SEQ ID NO: 57776 - DNA, 101 bp, rice(Oryza sativa)
  misc_feature (71): n=t or c
ggcagtggtggggcggtccaagtcgtcatccggactttcggaggcacctttggaacgtgaacacgtacggnggcgcagtagcggatgacggtggcgtcatt

SEQ ID NO: 57777 - DNA, 101 bp, rice(Oryza sativa)
  misc_feature (71): n=a or g
cggagaattagacagcttaccccctaagaggatctcaaattctcaatcctcctcttacatgaacagaacgnagtacagccaaaccgccaaatgtattggaa

SEQ ID NO: 57778 - DNA, 101 bp, rice(Oryza sativa)
  misc_feature (71): n=a or g
cttgattacatagctaatcttgatccgatgaaagatgctgacatgcttcgtatggagcttcctatgatccntgaagcatgccttagagtgctaatactctc

SEQ ID NO: 57779 - DNA, 101 bp, rice(Oryza sativa)
  misc_feature (71): n=a or g
tttaattacattcaatatatactttcatcaaaatgatgaggacaaaaacatccagaagttcacctcagatntttctttttctcattttgttttgttttaac

SEQ ID NO: 57780 - DNA, 101 bp, rice(Oryza sativa)
  misc_feature (71): n=t or c
cgaggcgaaaaatcgattcttgcaggacttggagacaaaaaagaatgcaaccgaactctccattgcacggntcgaggaggacaacaggaagctacacgatg

SEQ ID NO: 57781 - DNA, 101 bp, rice(Oryza sativa)
  misc_feature (71): n=t or g
agctcctcgaattcggggagattggcttctggatcgtcgggccccagagactcatcaacactatacactangttcccttcctcgtccacgaagctctccac

SEQ ID NO: 57782 - DNA, 101 bp, rice(Oryza sativa)
  misc_feature (71): n=t or c
tggactacaatacacaattgctaatgcctaacacaagctaagagctaggagatagatgctaataagattanatgagtggcctcgcatgaccacgtacgttc

SEQ ID NO: 57783 - DNA, 101 bp, rice(Oryza sativa)
  misc_feature (71): n=t or c
agaactttctcttagtaaaacttttactcgtgattaaatctaaaagtaaaggtttaacctgccctacccangtttggccgtgccgccgccaccgcccctcc

SEQ ID NO: 57784 - DNA, 101 bp, rice(Oryza sativa)
  misc_feature (71): n=t or c
tttgtttgtgctgttagaggagctactccctcctttattgtggacacacttatcaaaatactaaatggtangttttttaaaaaaaaatcctatataaaagt

SEQ ID NO: 57785 - DNA, 101 bp, rice(Oryza sativa)
  misc_feature (71): n=t or c
taattaacagcaagtgatgtggttaatgtaataactggatggtaattggatgctgcagggtgctgatcttngtgaggctgatcgcgttcacactgttcgtg

SEQ ID NO: 57786 - DNA, 101 bp, rice(Oryza sativa)
  misc_feature (71): n=a or g
ttatatgtaactgacagcacagagaaaaacttactctcagcattttgacaaggtatcaaagacaatatcangggacctaatgtgcgatacaaatgattata

SEQ ID NO: 57787 - DNA, 101 bp, rice(Oryza sativa)
  misc_feature (71): n=a or g
caggccctagccgatttgttctccttcgacatcagggattattttgatcagacagaagaagacaccaccancaaagctttagctcccttatccgatgatgt

SEQ ID NO: 57788 - DNA, 101 bp, rice(Oryza sativa)
  misc_feature (71): n=t or c
gggctagctactagtaagcttggcctggggatttcggagaagaacaagatttttctagcagggaatgagcnttggtacaagaaaattattgacccatcaag

SEQ ID NO: 57789 - DNA, 101 bp, rice(Oryza sativa)
  misc_feature (71): n=a or g
cgtgacactggtgattggtttgaatgcttgctcacgagttgggtggctgaggcttggaaaggagatccacnggctggcagtgcgtatgtgctgtgaccaag

SEQ ID NO: 57790 - DNA, 101 bp, rice(Oryza sativa)
  misc_feature (71): n=a or g
tccaagaccatcttatactctttgggaggcagatgcaatttgcagaatctagttggaagacccttgtaggntggaaaagaaacatagctatgagtactcat

SEQ ID NO: 57791 - DNA, 101 bp, rice(Oryza sativa)
  misc_feature (71): n=t or c
ctctggctccgccgaaacctcagccactaccctagcctcatcaccatcaagcagttcaccgtcctgagcanatgctgcctgtcgccgaggttgcccaccgc

SEQ ID NO: 57792 - DNA, 101 bp, rice(Oryza sativa)
  misc_feature (71): n=t or c
actcttggtcggtagtaaatgggtgaacatctgagtaagcgattcgaacccatttaactcttttcggagcnggttcaagtctgattctggcccgggttatg

SEQ ID NO: 57793 - DNA, 101 bp, rice(Oryza sativa)
  misc_feature (71): n=t or c
ggccttctttccacttcgaacttcagacaatccactactaggatggcaagattgttgaatacttctgtgtngccctccaataaaatttctctgtcaaaaag

SEQ ID NO: 57794 - DNA, 101 bp, rice(Oryza sativa)
  misc_feature (71): n=t or c
tcaaggcataatgcgacatggatgaatctgaagtctgaactcgcctggttgcatgcaggttcggcaacaangcccaacatctctgattgtcaatcaatggt

SEQ ID NO: 57795 - DNA, 101 bp, rice(Oryza sativa)
  misc_feature (71): n=t or c
gagactgatccgggaagcgtgaaggaccaccaggagtttcttgaccatctgttggtactccgtgatagtgngcctatggaaacctgcgtgctaaggtttag

SEQ ID NO: 57796 - DNA, 101 bp, rice(Oryza sativa)
  misc_feature (71): n=t or g
cattacagcttcgcggctatctgaacatggccatgcatggcgaatcctgcatactcacggcgattcctttnagcttgatgggggtcgcgtgcgggagcaag

SEQ ID NO: 57797 - DNA, 101 bp, rice(Oryza sativa)
  misc_feature (71): n=t or c
ttggcgtcgacggcgccttctagtcccgcatttatttatgtcagtcagcggtgaactgaactctggtcgantgttgaccagggtcagcgtatccgtctcac

SEQ ID NO: 57798 - DNA, 101 bp, rice(Oryza sativa)
  misc_feature (71): n=a or c
tttaaaggtgaacgaggcagctggtcgattattcctagaggccgtcagcttcgagggaggcataaccatcncctacatctggcggtacatcagcgccgagc

SEQ ID NO: 57799 - DNA, 101 bp, rice(Oryza sativa)
  misc_feature (71): n=a or g
gcattttttttcttaaaaacaaagatgttcattcacaattacctcattgctgctgggatacaatttgaccngctgatgctgcaacttgcccttctgccagc

SEQ ID NO: 57800 - DNA, 101 bp, rice(Oryza sativa)
  misc_feature (71): n=t or c
atgcaagctcttagacaagattgacttggctagcttgtggtaaccctacattagcaataatgaattgattnggttaaacacgtgcgcattggggtggtttt

SEQ ID NO: 57801 - DNA, 101 bp, rice(Oryza sativa)
  misc_feature (71): n=a or c
ctctagaatcatgtttccctttttgccaactgcgccaactgaacatcgatggtgtattatccattaaagtntttaaactaaggagtaaaatatgaaagttt

SEQ ID NO: 57802 - DNA, 101 bp, rice(Oryza sativa)
  misc_feature (71): n=t or c
gaagatcatagatttgctccaagctcagttctagaagaacaactactgattgtcctgttggttgcaccatnaaggacagtatactacatgcacctgatgct

SEQ ID NO: 57803 - DNA, 101 bp, rice(Oryza sativa)
  misc_feature (71): n=t or c
gcatgcatacataacttgcatgcaagtttataaccatttttcctcaaaactaattatgtgattcatgatcngattattttggtatattcgtagttattaaa

SEQ ID NO: 57804 - DNA, 101 bp, rice(Oryza sativa)
  misc_feature (71): n=a or g
ggatgatggaaagattttgttctgtgcatgatatcgagtgttctgtatagatatctctattgttatgtatnatgctattgatgctcttattgtaccataat

SEQ ID NO: 57805 - DNA, 101 bp, rice(Oryza sativa)
  misc_feature (71): n=t or c
tcccggaacaatcctgtccagtggtactgaaaatgatagccatgtactacatgaagaggtaccacacgtanatacataatacttccatgtgatcaggctgg

SEQ ID NO: 57806 - DNA, 101 bp, rice(Oryza sativa)
  misc_feature (71): n=t or c
ggtctctgtgtgggttggtaaagactgaggcgtatttataactgggctcgattgggccaaaaacttctggnccgttgctaggtgggcccgtcggaaatctg

SEQ ID NO: 57807 - DNA, 101 bp, rice(Oryza sativa)
  misc_feature (71): n=a or c
ccatagttttagtgactgtttcctcattttctcctctctttctctccacctcttagcgctctttctctctntatggtcgagacgatggtgaggaccggtag

SEQ ID NO: 57808 - DNA, 101 bp, rice(Oryza sativa)
  misc_feature (71): n=t or c
cctcaagtgtccgacctggaaaatgacatccttactgctaaattttcagaaaaggaagtcaaagaggtaanttttcaaatggatcataactcctccctagg

SEQ ID NO: 57809 - DNA, 101 bp, rice(Oryza sativa)
  misc_feature (71): n=t or g
atgacgtgatccggcacgttctgcatatgtcatctacgagtacgatttgtgcgggtatatatataggatcntctctacaattctattcccgtcctaaaata

SEQ ID NO: 57810 - DNA, 101 bp, rice(Oryza sativa)
  misc_feature (71): n=t or c
tgtgggtagaagatcacaccagccagaatgtggatgagcaaaacatcgggacaatagatacatagatacgntaacaaggctttgtaaaatgtgtatcatta

SEQ ID NO: 57811 - DNA, 101 bp, rice(Oryza sativa)
  misc_feature (71): n=t or c
tcgtgaccagaatgtacctttttgttttgttcaacttcaaccacctcggcagcctcgtcatccatggagtnggcaaccacgaccacttcctcgccagcaat

SEQ ID NO: 57812 - DNA, 101 bp, rice(Oryza sativa)
  misc_feature (71): n=a or g
catttgagtatgtgcatgtgtggttcaatattgtaagtgtaggtaaatcatttggttgcttctgaggacanaacagaagtgttattggctagtaggagtat

SEQ ID NO: 57813 - DNA, 101 bp, rice(Oryza sativa)
  misc_feature (71): n=t or c
ttcccatgttttgatttctcgcgaaccatccaaacacaccaattctagtatgctttggaaccctgtaggantgtgttgaacatgacatcctcttcatgcat

SEQ ID NO: 57814 - DNA, 101 bp, rice(Oryza sativa)
  misc_feature (71): n=t or c
ccgtgccggagttcatgcgttctcgaagggaatccggccatggcaagtcatcgatcgattcattcaggatngctgcagattaacgacggctcagcaggcaa

SEQ ID NO: 57815 - DNA, 101 bp, rice(Oryza sativa)
  misc_feature (71): n=t or c
gcgagttcgaacttggccacctttcacaaccgcacgcttgcgtttcttcgaagtgccaactttgtcatccncagctctggaggggttcgatcgacttggca

SEQ ID NO: 57816 - DNA, 101 bp, rice(Oryza sativa)
  misc_feature (71): n=t or c
tgcatcagctactgaaactacaccaaccaaagttctagcagcaactcaccaattcttagcatcatcagcantcctgaggtaggcctcaattcggccctccc

SEQ ID NO: 57817 - DNA, 101 bp, rice(Oryza sativa)
  misc_feature (71): n=a or c
tcgctgttggcgcgcacgcgccagctagcagcccccgtatcgtatagttgtatgcgccactgttaacaacngaatttggtaagtattcgtatcagtaaagg

SEQ ID NO: 57818 - DNA, 101 bp, rice(Oryza sativa)
  misc_feature (71): n=a or g
atatgcctaacaaaaaagatcataagcacctaaataagcaaacaataatatatatcacctgtactgtgtgnaaagtacgaagcttggagtagtcgaaacat

SEQ ID NO: 57819 - DNA, 101 bp, rice(Oryza sativa)
  misc_feature (71): n=t or c
aaaataattagctataaatacgaaccacatatcaagtctagaatttaaaccggataggctgcttccattanaaagaatctaactaattgtgctatgcttac

SEQ ID NO: 57820 - DNA, 101 bp, rice(Oryza sativa)
  misc_feature (71): n=t or c
aggagccagccttatcagaattcagatgggctactctgcttcaaaagctcggccctcgcttcatcgtggcngggcgggagcagctgcaggtgttcgaccat

SEQ ID NO: 57821 - DNA, 101 bp, rice(Oryza sativa)
  misc_feature (71): n=a or g
agttacctgatattttctactgactaaccgtatgaactctctttgatatgaactctaatctatctaacttntagttcaacaacttattttactcattcatc

SEQ ID NO: 57822 - DNA, 101 bp, rice(Oryza sativa)
  misc_feature (71): n=a or g
ccacctcatatcttttcctttcctctcctcgttctcttctccaccaccggtggctaaggcggagatgacgncctcgcaggcgggctctggcggcatgcaga

SEQ ID NO: 57823 - DNA, 101 bp, rice(Oryza sativa)
  misc_feature (71): n=a or g
cgcgtccgcagtgctccgcaacctcggtgaaaccagaagtgaatccatcgtgcccggcgaggcgaggacgnaggcttgtgccggtggtggcagcatggctt

SEQ ID NO: 57824 - DNA, 101 bp, rice(Oryza sativa)
  misc_feature (71): n=t or c
tcattccatcttctgctagccataagaaatcgtgaatccttggaagatgttgcctgaatgcataagaattnggattttctatccagcaacatatcatattt

SEQ ID NO: 57825 - DNA, 101 bp, rice(Oryza sativa)
  misc_feature (71): n=a or g
aattgttgttgcctacgcctacttggggacaactttttcagtgctccccctcaagacattcgcaaattccnccggattccttttcgatgatgctttttcta

SEQ ID NO: 57826 - DNA, 101 bp, rice(Oryza sativa)
  misc_feature (71): n=t or c
atatttctctaaagaagaatgggaaaaggagaagacagaagaacgtgtggaagaggagaagagagaagaangtgagcaagaggggaagaacacagaagagg

SEQ ID NO: 57827 - DNA, 101 bp, rice(Oryza sativa)
  misc_feature (71): n=t or g
gggaggagaagtgagatgagagctcagcttgaggaaaaaaaagaaagaacaagcagtgaagatgaaagggnaggaagaagaaggggttatctctgcccccc

SEQ ID NO: 57828 - DNA, 101 bp, rice(Oryza sativa)
  misc_feature (71): n=t or c
aaattttagaataaaaaaaatttgcacttagtgataaagttgtggacaatttaagtacttggttggttggntggttgaacaatatgttaatggttgtaact

SEQ ID NO: 57829 - DNA, 101 bp, rice(Oryza sativa)
  misc_feature (71): n=a or g
tttatgttttgcctttggtaaaaaagaaatgccattacatgattctaaatcatgagcatttgaatatttcnagttgtttactaatatgcttctgtgataca

SEQ ID NO: 57830 - DNA, 101 bp, rice(Oryza sativa)
  misc_feature (71): n=a or g
tttttttcttttcagcctgtcacaattaaatcagttacgggatcaacggtgacagctttgaaatataaccntcaccaatattataaataatacttttaaac

SEQ ID NO: 57831 - DNA, 101 bp, rice(Oryza sativa)
  misc_feature (71): n=t or c
aagaggcaccacagtctagcaaaaagagaaacaggaagaacgggaagcgcaaagcgataatggaggttctngccacagaacaggcagacccacccaagcac

SEQ ID NO: 57832 - DNA, 101 bp, rice(Oryza sativa)
  misc_feature (71): n=a or g
ctgagtgatatcaccttaagcttctgctcatacattgatgacactggtcttggttatctagcattttgcangaaattgatcaccctcagactgaactctgc

SEQ ID NO: 57833 - DNA, 101 bp, rice(Oryza sativa)
  misc_feature (71): n=a or g
acaatattatatattttaaaaatagaaggctctttatgtttctatgcgtacagtggtaatttgtgtctacnatatatttaaaaataaaattgttggatggt

SEQ ID NO: 57834 - DNA, 101 bp, rice(Oryza sativa)
  misc_feature (71): n=a or c
acaaatcaaatcaaatttgtaagtttcagtgagatattcgtgcgaaatttgtcaaacttaattaacggagnaattctacggttcttcaaaatatatcatga

SEQ ID NO: 57835 - DNA, 101 bp, rice(Oryza sativa)
  misc_feature (71): n=a or c
gagcaaaataacatatagaacaaggccacccctttgacatataagggtaacctgaattacggaaacaactntgcggccgaaacaatacaacagtaaaggat

SEQ ID NO: 57836 - DNA, 101 bp, rice(Oryza sativa)
  misc_feature (71): n=t or c
ttacagttcatgcattacatgcaattatgacgtcttcatcatgcccacgtaatttcgctgtatgtacatcntaatatgatacgaataagaggcgtcatgaa

SEQ ID NO: 57837 - DNA, 101 bp, rice(Oryza sativa)
  misc_feature (71): n=a or g
tatatgtttcaatacatatatatatatatgcataatatatatagacacgcacacggtagcgctacacgaancgactcatagatcatggcgtgctatgcaat

SEQ ID NO: 57838 - DNA, 101 bp, rice(Oryza sativa)
  misc_feature (71): n=t or c
tctgagcgacaatggatggtgggagacgatgccgtcggctcaatgaaggctgaaaaagagagggtgatganatgcgggacccatgtttttcccttgcactt

SEQ ID NO: 57839 - DNA, 101 bp, rice(Oryza sativa)
  misc_feature (71): n=a or g
cagaccatgtgaaaactgaccaggacaataactttagcatgccaaactataagtaaataacataccgagcnaagcttagctccaaaatctggagtaaagtc

SEQ ID NO: 57840 - DNA, 101 bp, rice(Oryza sativa)
  misc_feature (71): n=a or c
atcacattctagtatgatgttggtttattttggtgtggtgtcgcgtgttctctaaacgcactgtgtcgtgnttcatccatcttaaaataatcttatctttt

SEQ ID NO: 57841 - DNA, 101 bp, rice(Oryza sativa)
  misc_feature (71): n=a or g
tttctgcccgtcattcagcaatacggagtacttcatcttcagaaatggagtaagttaattttgtccacggntatagtaataagatatgtcacatatcatac

SEQ ID NO: 57842 - DNA, 101 bp, rice(Oryza sativa)
  misc_feature (71): n=t or c
gtcagttggcagtccatcaagcaaaaggttgtcgcgctctcgtcttgtgaggcggagtacatagtggcgangacggcggcgtgtcagggaatctggctggc

SEQ ID NO: 57843 - DNA, 101 bp, rice(Oryza sativa)
  misc_feature (71): n=t or c
caaaggcagtagctgtattggcttccagcttttcctctctacctctaatgatagcttggagcaagttcaanagtatagctaactactagctctaattcatc

SEQ ID NO: 57844 - DNA, 101 bp, rice(Oryza sativa)
  misc_feature (71): n=a or g
ctcggagattccaaatggacattgatagattcaaagctagaatacccagtgacctgtgtcgtgcactgtcnagacagttttgtcgctattggctccctcgg

SEQ ID NO: 57845 - DNA, 101 bp, rice(Oryza sativa)
  misc_feature (71): n=a or g
taacaacaagttgcagcaccatcggtcaactcaaacgaacgtcaaacatgcctagtagtaccgcttaaaantaaacccatactatgtactctttccgtccc

SEQ ID NO: 57846 - DNA, 101 bp, rice(Oryza sativa)
  misc_feature (71): n=a or g
gaacttgtggaaattgaacagcagaggtaaccgacgtgtacaacatactgaaactggcatgtatcacttantgtcataactcatgacaacgatgattgtac

SEQ ID NO: 57847 - DNA, 101 bp, rice(Oryza sativa)
  misc_feature (71): n=t or c
ccttcaagatgaggccacggatctgatcccatggtgattcaatctctgatccaaacacactcttcagccantgctccagagtcccttccagtccttccctc

SEQ ID NO: 57848 - DNA, 101 bp, rice(Oryza sativa)
  misc_feature (71): n=t or c
aattgatttctcgtctatgtgccccccgaaaattgatacagctgtagcatttggactcatactcgatggtncatctaagctgtgactttatgatgatattt

SEQ ID NO: 57849 - DNA, 101 bp, rice(Oryza sativa)
  misc_feature (71): n=t or c
gacaacttgacccatatcaaagagaaaaaggaggtatagtacataccgaccccaccaaaaaccaaaagtanaaaagttttacttaggcctagtttagttcc

SEQ ID NO: 57850 - DNA, 101 bp, rice(Oryza sativa)
  misc_feature (71): n=t or c
gcttgttgttttggcagaactgaacttataacaggcactttctaatagtttgtacggctgtacgcgatgantgacgagttaaaatgagcctaaagaacatt

SEQ ID NO: 57851 - DNA, 101 bp, rice(Oryza sativa)
  misc_feature (71): n=a or g
gctcgccgtttcgtttaaattaaaaaaatcgaaccacaccaggtagtgtaaatttgtcatcgaagaacatnaaataaataatattctactacataatacta

SEQ ID NO: 57852 - DNA, 101 bp, rice(Oryza sativa)
  misc_feature (71): n=t or c
gatcgtggagcaacttgtgtcggggcccaagaaagaggtgataaagatcacttctatgcagaagcagaccngtgcctggtagtgcatcaagttcaagatgt

SEQ ID NO: 57853 - DNA, 101 bp, rice(Oryza sativa)
  misc_feature (71): n=t or c
tgtccaactcacgtatgaatgaactacatcaacgattgcaaacggctgcaatacatatgaatatactctcntttgattgatacatggttgcatatctctag

SEQ ID NO: 57854 - DNA, 101 bp, rice(Oryza sativa)
  misc_feature (71): n=t or c
tgggataaaaaaggactgaagtttagatgcacacagccctactactcctatatcccatcgactgacgactngtcgacagtgacaattgttttggaagtatc

SEQ ID NO: 57855 - DNA, 101 bp, rice(Oryza sativa)
  misc_feature (71): n=t or c
aaatttgcaatacggaaatccagtttaatttaatactgcactgccgtacactggaacagtatcaccttctngaaagttcaaacccactcatcgaaattcca

SEQ ID NO: 57856 - DNA, 101 bp, rice(Oryza sativa)
  misc_feature (71): n=a or g
ccagcatcagcgcaccaaacacattgagattgacctccattttgtccgggaacatgttgcccttggtgctnttcgagttctccatgttccaaccacctctc

SEQ ID NO: 57857 - DNA, 101 bp, rice(Oryza sativa)
  misc_feature (71): n=a or g
gattaacgaaatcatcatagacgtttctctaaatgcgagaaactgtgtcaaaaccataacttatgcctagnttggctgattacgtcacaaggaatctaacc

SEQ ID NO: 57858 - DNA, 101 bp, rice(Oryza sativa)
  misc_feature (71): n=t or c
aagggaatatatatatgcaacagtcggctggtaaatcgattaattagacagtgttcaagttcaacgcgctntggcaaaggaaccaaagaacagtaaaattg

SEQ ID NO: 57859 - DNA, 101 bp, rice(Oryza sativa)
  misc_feature (71): n=a or c
tgatgtaattttacatttcaatcatcgttcatgaggtaaagtgagctacaactgagtttaaaatttggatnaactagaagtgaagttccaggcaaataaga

SEQ ID NO: 57860 - DNA, 101 bp, rice(Oryza sativa)
  misc_feature (71): n=t or g
tgaatgataaggaactcgataacacatggggtataaattaaacagcatttccacattcctaacgacatcangctctgttttccaggtcctgctacggccat

SEQ ID NO: 57861 - DNA, 101 bp, rice(Oryza sativa)
  misc_feature (71): n=a or c
taaagtaaacatgtgaccatgtgtcattcatagttaggggaaccttagcttatctttcctagtactccctntgtcccataatataaggaattttatgtttt

SEQ ID NO: 57862 - DNA, 101 bp, rice(Oryza sativa)
  misc_feature (71): n=a or c
agtacatagctaggatcactggttggtggctactggccatcaatttggtatcctcactttgaattgttttnattgtcccctcctctcctctcccatcgcgt

SEQ ID NO: 57863 - DNA, 101 bp, rice(Oryza sativa)
  misc_feature (71): n=t or c
ttctgtgtgttaggctgtgttccggaggaagccctcctctcccgcacgtaaattgatatataaattaacanatgactaacttggtattagctaatttttta

SEQ ID NO: 57864 - DNA, 101 bp, rice(Oryza sativa)
  misc_feature (71): n=a or g
ttatggatggtacatagagagtttttttttcttgcgatgtactgaacaattcccttgtgctgacttgcgtntatcttttaccagaagcagctaatgttgtt

SEQ ID NO: 57865 - DNA, 101 bp, rice(Oryza sativa)
  misc_feature (71): n=a or g
gaactcaagaccttagggtgctactcatgtcacatcaaccactaattcttggaatgactctttttgttgcnctagagtgactggcatcgtccacgtgccac

SEQ ID NO: 57866 - DNA, 101 bp, rice(Oryza sativa)
  misc_feature (71): n=a or c
ttttccatgctctttttggctatacaagcttgttcagaacttattttttgcatatcatcctgaagacttgnagctgcaggtgatggtggagggatcaggat

SEQ ID NO: 57867 - DNA, 101 bp, rice(Oryza sativa)
  misc_feature (71): n=t or c
cctattaatttcctaaaaaaaacagtgcgtgttcaagttgttggtctagatccgagtgaaaaagaatcaanctcctcatattgatgttcattttattaaaa

SEQ ID NO: 57868 - DNA, 101 bp, rice(Oryza sativa)
  misc_feature (71): n=a or g
cgcatcagcttcccctcggcgatatttctttgaggcaagacatcatccttaatgccttgtttatgcaacancttttttgttttttttatttcttattgatt

SEQ ID NO: 57869 - DNA, 101 bp, rice(Oryza sativa)
  misc_feature (71): n=a or g
agagggaggatcaccggctctcctactatccttatttcaccacccctgtatctccatcctttttttgttcnttcgttgttccaaacaaatcgtcatctaga

SEQ ID NO: 57870 - DNA, 101 bp, rice(Oryza sativa)
  misc_feature (71): n=t or c
tcgagcccagcccaactgccgcgttgggcgatgtatcaatctggacagaaaaaaaaaggaaaaagtacacnggaggtccctcaacttgtcatcgagttaca

SEQ ID NO: 57871 - DNA, 101 bp, rice(Oryza sativa)
  misc_feature (71): n=t or c
aatataatttccatttgtaataaaaaaaaacataggctggatgtaacatatgtgtttggaccttgccttcngaggtgagtcttgctcagcaccctcatttg

SEQ ID NO: 57872 - DNA, 101 bp, rice(Oryza sativa)
  misc_feature (71): n=t or g
gcatagtggtatgctatggcagaagagaacacgagacagaagaaaagagaattgaagggagagtagccgangccggagtgagggagcaaaggctgacgaaa

SEQ ID NO: 57873 - DNA, 101 bp, rice(Oryza sativa)
  misc_feature (71): n=t or c
taaagttacaacccactaaaatctaaaactcaacatgcaaaaagaaggtcacatcatcttccactagcaantattacatttgaacatctgtacagaatgtt

SEQ ID NO: 57874 - DNA, 101 bp, rice(Oryza sativa)
  misc_feature (71): n=a or g
tggagcagcccacaagaaattcagggcggtagaggtcgatgatgttgtggcggctgtcttcaggactgcanctggcacctcatatacatcatcagtgtagc

SEQ ID NO: 57875 - DNA, 101 bp, rice(Oryza sativa)
  misc_feature (71): n=a or g
atgacaggttgagaaatattagtttaagcttccacaaatcggtatgtatggtcccaattatttggttgccncctaggtcaatccaattgagctctttgctc

SEQ ID NO: 57876 - DNA, 101 bp, rice(Oryza sativa)
  misc_feature (71): n=a or g
cgagaacttcggcctcagccttgttctttttgttcctcttgaaggactgcttcgtcttcttgctagttccnggttcttccttctttgctggcaccttgtca

SEQ ID NO: 57877 - DNA, 101 bp, rice(Oryza sativa)
  misc_feature (71): n=a or c
tcttcatcatcatttcagcacacaaacggaactccaagaactaactttcaaccgagcacagggcagatcanatcatttttggtgtaaacgtttgttatatc

SEQ ID NO: 57878 - DNA, 101 bp, rice(Oryza sativa)
  misc_feature (71): n=a or g
aacaagcgcacctgcaacattttgaaaccatgcagtcggacctctgaagactggtcctttcggaccaatanaaatgatgtgttcgccaatgcccggacatc

SEQ ID NO: 57879 - DNA, 101 bp, rice(Oryza sativa)
  misc_feature (71): n=a or g
gactgataaggctgtgtttcggcgcattaggtttctaacatccactccctcgttgtccacacatgcttctnaaactgataagcggtgttttttttaaaaaa

SEQ ID NO: 57880 - DNA, 101 bp, rice(Oryza sativa)
  misc_feature (71): n=a or g
ttaacttttaaaccgaatataactcacccctcaactttcaaaactgtctaatttacacctcttcgttcccnatgaaggtggtttttgcccatgcggcgatg

SEQ ID NO: 57881 - DNA, 101 bp, rice(Oryza sativa)
  misc_feature (71): n=t or c
atcagtctaatgcgaaaagtgaacatttggtggaacttttaggttgctactggtctatagcttgaaccgtnccccaaaccataaaaagtaggtcaaaagtc

SEQ ID NO: 57882 - DNA, 101 bp, rice(Oryza sativa)
  misc_feature (71): n=a or g
ctctgcctccatcgttgtggccggcaacggcaatcatcagtcgaccttgctctggtgggcaactgtcactnctacgaaaaccatttttcgtggcggtcatt

SEQ ID NO: 57883 - DNA, 101 bp, rice(Oryza sativa)
  misc_feature (71): n=a or g
tcttctcgtctcgaatcttaaggcgtttcggaatccgaattttctacgatttttcttggccgtgtttggtntcgcggttctctggttcgatcatgtcttcg

SEQ ID NO: 57884 - DNA, 101 bp, rice(Oryza sativa)
  misc_feature (71): n=t or c
gttaattgtagttctagtgtgcgaaggcgtgcatttatgacttcaatgcaatgtatttagtgcttttactntcttgctctaaagttggagtaggaaaaatt

SEQ ID NO: 57885 - DNA, 101 bp, rice(Oryza sativa)
  misc_feature (71): n=a or g
cggagggagtacaaatttaccaccccaatactgcactgtgccactgtctacgtgtactcgaatagcttgancaaactgtagccaatggcgagacggatggt

SEQ ID NO: 57886 - DNA, 101 bp, rice(Oryza sativa)
  misc_feature (71): n=t or c
ttcgaccgacgctcctgccgaaacctattatggattcctgcagagaaaacgtgcattgtgtgtacgtgtanttttatggttagtaacgttttgtaggtttc

SEQ ID NO: 57887 - DNA, 101 bp, rice(Oryza sativa)
  misc_feature (71): n=a or g
atttttctggtctatttacattatttgctacattattttttttggatcagttgagctgtacatgttatatnaaacacagtcttgtaacagattttctctat

SEQ ID NO: 57888 - DNA, 101 bp, rice(Oryza sativa)
  misc_feature (71): n=a or g
ggtctgcgcaaaatattctatcatatgaggaggttagcatcacttgtgttggtgagatgtttaccataatnccatcgtaatcagtactaacaaagcggttt

SEQ ID NO: 57889 - DNA, 101 bp, rice(Oryza sativa)
  misc_feature (71): n=t or g
gtctgtattttcttcccttgtcgatcatatgttgttgacttatgaccagaagcaatagccaacaagagagncactaaaggaaggacctattttttatagta

SEQ ID NO: 57890 - DNA, 101 bp, rice(Oryza sativa)
  misc_feature (71): n=t or c
ttgcacaaattgcatcgataaagattgaattgcatacagtatattcctgatttgttaataaatcaaaaatncaacaatgttaaatccaaattcacttttgc

SEQ ID NO: 57891 - DNA, 101 bp, rice(Oryza sativa)
  misc_feature (71): n=t or c
gacacctcacgcctcttctcgtctccactccccagtacctttagctctaagccctaggaaaactgaggtgnttttttgttcttgtgttatttctttaattt

SEQ ID NO: 57892 - DNA, 101 bp, rice(Oryza sativa)
  misc_feature (71): n=t or c
catgtcagaaaagctgactcaacactagtacaactgacctgaactatggtagcatttcagcaaaatagagnaattttatcactttgactactgaaacaaaa

SEQ ID NO: 57893 - DNA, 101 bp, rice(Oryza sativa)
  misc_feature (71): n=a or g
tgagcctagatacctgtctgagatagcgggattgaagtctattgtgtacatcctgaacatgataattttanagtaaattgcgcccgcggtacataaacttg

SEQ ID NO: 57894 - DNA, 101 bp, rice(Oryza sativa)
  misc_feature (71): n=t or c
ccttagataagaaattttgtagaaagtttaatgtttcctgcatcaaagttgggcaacttgacccatgtctnatgcagcccatgctggctattcagcagctc

SEQ ID NO: 57895 - DNA, 101 bp, rice(Oryza sativa)
  misc_feature (71): n=a or c
gatggctagtattttgtgtgtgttttttcgttgattatgatgggggtgtgtggggggaaagaaatctcatntttggcctcttgttcttgtcctcacttcag

SEQ ID NO: 57896 - DNA, 101 bp, rice(Oryza sativa)
  misc_feature (71): n=a or c
ccaaccaaaaggtagggattgacttgtactataagctcctagtaccaggacaacctcctaactcctaaggncaggtaccaaaggtcgaaaccatctactcc

SEQ ID NO: 57897 - DNA, 101 bp, rice(Oryza sativa)
  misc_feature (71): n=t or c
ggatttgctcccccacattgtctacatcacccacttctcttctctctatcttttctccccaaccacgacancgacagcctttacaatggagcctctcgacg

SEQ ID NO: 57898 - DNA, 101 bp, rice(Oryza sativa)
  misc_feature (71): n=t or c
gaaaataagtgacaggacgacgtgaagaatacatgggatttaatttaaaaaaatttcagtaccatccacgncaaaattaagggtgtgtttagttgcacgtt

SEQ ID NO: 57899 - DNA, 101 bp, rice(Oryza sativa)
  misc_feature (71): n=t or g
gttggtgatttattactgatcggtggtaatacgcgagatgtgtttaaaatttgagatgtgtttaattttcntaccatttgcacctttgcgggcccaactaa

SEQ ID NO: 57900 - DNA, 101 bp, rice(Oryza sativa)
  misc_feature (71): n=a or g
gttctagtttattacgcaggagtatctagactctcactgcaatgcagctagtagattttctggaagcaatncggaacttaacatctttgaattgatatgta

SEQ ID NO: 57901 - DNA, 101 bp, rice(Oryza sativa)
  misc_feature (71): n=a or g
gaggaagtagaaatgaagatgttaatgaccaaccattcttcaacccaaatatacattatttaatatttacnagagatgctaaaattatttatatattttaa

SEQ ID NO: 57902 - DNA, 101 bp, rice(Oryza sativa)
  misc_feature (71): n=t or c
caccgccaccatggtggagtgggaggttcgcctcgctatcgtctatggctacatcgctcccggttagagcntttgcctactccgacggcggcggcggacac

SEQ ID NO: 57903 - DNA, 101 bp, rice(Oryza sativa)
  misc_feature (71): n=a or g
ctggatccatcgcctccacggccagatcagccacatccacctatgcagcccctgccctttgtcgtcaccgnccaccaccgccacctccccctttgccacgc

SEQ ID NO: 57904 - DNA, 101 bp, rice(Oryza sativa)
  misc_feature (71): n=t or c
ccaacattgtttttctttttctagcagaatgtggctacattcatcacttcatttcagtttcgacgtaattncaattcattctgtctttgttgagaaatttt

SEQ ID NO: 57905 - DNA, 101 bp, rice(Oryza sativa)
  misc_feature (71): n=a or g
aatccaaccttttcgccactcgttggagaacataggtaggaaattttcctcaagatttttttgtcaacgcnaaagcaagttatttattttgcaggtacgca

SEQ ID NO: 57906 - DNA, 101 bp, rice(Oryza sativa)
  misc_feature (71): n=t or c
agactttgcaacatccttgtaagttagactctgaatcaaagatcaaagaatgatcacgagtagggtattanactccacgcggccccaacttgcataaccga

SEQ ID NO: 57907 - DNA, 101 bp, rice(Oryza sativa)
  misc_feature (71): n=t or c
taactcgctagtgctcgactaccttgtgcatccaatcgtgtagtgtacagtttcctatcaacttttcactntgccaaaaacgtataggggatgaaagtcta

SEQ ID NO: 57908 - DNA, 101 bp, rice(Oryza sativa)
  misc_feature (71): n=t or c
gcaaatatatcaaccgaaccagagcgatccaaaagatcaaaatgaaccgccggcggaatgtaggacttacnccttcgccgaagatcgaactgaaccgatgc

SEQ ID NO: 57909 - DNA, 101 bp, rice(Oryza sativa)
  misc_feature (71): n=a or g
attgcagtggctgttctctgtgcctttcattctcttaatttcggtttcgctcctgttctgaagagtggggnaaaaaaattaaggcagttcttagctttggg

SEQ ID NO: 57910 - DNA, 101 bp, rice(Oryza sativa)
  misc_feature (71): n=a or c
attaatctaattatcatgttgactcacatactttgtcctggtattagatgatatatatccgcttctgccanaaaccctaaccccttcgctgcgtgccatgc

SEQ ID NO: 57911 - DNA, 101 bp, rice(Oryza sativa)
  misc_feature (71): n=t or c
cgggtagtccaatgtactcttggcccattgccctctgacaattaacctgtggagttctgtggaacttggcntgagagcctcaaaagaaagtggctcattct

SEQ ID NO: 57912 - DNA, 101 bp, rice(Oryza sativa)
  misc_feature (71): n=a or g
tagagccccagacgttttcccctcgaaaaaaagaatagtacggagtactagataagaaaaagataaggganacgaatgacaccttttttttttaaaaaaaa

SEQ ID NO: 57913 - DNA, 101 bp, rice(Oryza sativa)
  misc_feature (71): n=a or g
atatgacggttagactcatcgggcttctcaaaagctgcatctcttggtccttgtgaaattaggcaattctngcctcatccgtggcacggaactccataggc

SEQ ID NO: 57914 - DNA, 101 bp, rice(Oryza sativa)
  misc_feature (71): n=t or c
tattttgttatatgccattttcgaagatggcattcagatgtgcaagtgcacaaacaaactatagttgtggnatattaacctgtcaagctattagctaaact

SEQ ID NO: 57915 - DNA, 101 bp, rice(Oryza sativa)
  misc_feature (71): n=a or c
atcgaaaagtctagagactcaagagcgtcgtgaagtcagagggtggagaaagagagagctcgccatgaaantgacaggggtgcggcggtgaaaaaaggggg

SEQ ID NO: 57916 - DNA, 101 bp, rice(Oryza sativa)
  misc_feature (71): n=a or c
ataattaactgtcaaaaccaaaaatactccatccgttctaggaggttgttttctttggacttattccatcngtcctataaaaaaaccaatctaatactgga

SEQ ID NO: 57917 - DNA, 101 bp, rice(Oryza sativa)
  misc_feature (71): n=t or c
acagccaatggctactagccacagtttgcagccaaacacacccatgagcttgtgtgttctatcttcgaacnagggtgtgtttagttcacacaaaaaataga

SEQ ID NO: 57918 - DNA, 101 bp, rice(Oryza sativa)
  misc_feature (71): n=t or c
ctctataggtgagttggtaagggtagtcttcgtagatagggaagtctttgtgttcaatactcaacaaatgngtgaatatctatatagctcataaaatcatg

SEQ ID NO: 57919 - DNA, 101 bp, rice(Oryza sativa)
  misc_feature (71): n=t or c
gaaagaattcagcccattaaagacctaaagaactgatggagtcagcccataaaaaactgacccattaaaanttggagaagtagaacatgcatccaaagctt

SEQ ID NO: 57920 - DNA, 101 bp, rice(Oryza sativa)
  misc_feature (71): n=a or g
ctttcaaagaaaaagttgtactaattaaggaatctcgcaaaagaacaggttgtacctagatcggaatggtnaccagccatttctactacaacaattttata

SEQ ID NO: 57921 - DNA, 101 bp, rice(Oryza sativa)
  misc_feature (71): n=a or g
ctatcaagagggatagtaatcctcgcaaagaagtggtcaaaataccatattagtgcatatgtatgagggtntctttgttttggctttggtcccttgctttt

SEQ ID NO: 57922 - DNA, 101 bp, rice(Oryza sativa)
  misc_feature (71): n=t or c
cgctggtgaggtggacataagagggagtgggaagggaatcccttctccatcctttcgccactctcgctctngcatccacgcacctcagccccctgcgttcc

SEQ ID NO: 57923 - DNA, 101 bp, rice(Oryza sativa)
  misc_feature (71): n=a or g
agcctgctattgtacctgctcttagcttctttttgtgtgtttgattatgtggctagatttagggtgtgttngtaagttgggattggaaacccatctcctcc

SEQ ID NO: 57924 - DNA, 101 bp, rice(Oryza sativa)
  misc_feature (71): n=a or g
tatgtttcttcttatgttgcattgtaaaggagaactaagagtctttgaaggaaagtaaacccaaaatatcnagaaatgcggatcatatattttcaacaatc

SEQ ID NO: 57925 - DNA, 101 bp, rice(Oryza sativa)
  misc_feature (71): n=t or c
agtcgtcattgtccaagtcccactcaaaatttacttttggatcaggttttttttgtgtgttttgatgcttnctattattggcttcttctatgatccaaggt

SEQ ID NO: 57926 - DNA, 101 bp, rice(Oryza sativa)
  misc_feature (71): n=t or c
ttttcgaaggcaaagctactgcaacattaattttcacaagctagcgtcgacagctgcacctctctagtgcnactggccatttctctcactgcagccactac

SEQ ID NO: 57927 - DNA, 101 bp, rice(Oryza sativa)
  misc_feature (71): n=t or g
ctttgctaaaatacaattgttaaattgtatgtatgttgataataagccaccatgtaagattcatggttctnaacatttttatcattacaaatataaaaata

SEQ ID NO: 57928 - DNA, 101 bp, rice(Oryza sativa)
  misc_feature (71): n=t or g
atggtttctctttgctcttctcccatgtacttaacaaaagttctagaacccttagtttgggtagatcgctnagctctttcataagacttggatacatgctg

SEQ ID NO: 57929 - DNA, 101 bp, rice(Oryza sativa)
  misc_feature (71): n=a or c
cactccattcaaaaagagagaggagcatattaaagtaattaaaaactagagtggtggagtgagatttgaancatttctactgtagacttcactcctgtagt

SEQ ID NO: 57930 - DNA, 101 bp, rice(Oryza sativa)
  misc_feature (71): n=a or c
ttgtggctcatatttacgtgagcataatctttttctgaatgtgacaattacttactccctccgttccaaanaacctcaacctaggaggggatgggacggag

SEQ ID NO: 57931 - DNA, 101 bp, rice(Oryza sativa)
  misc_feature (71): n=a or g
atcgaggcactgttaccacattttcttctacagcaactccgttttcttcgtggcatccgtcgttgtcatcntcctgttgctgccagaggaattgctagaga

SEQ ID NO: 57932 - DNA, 101 bp, rice(Oryza sativa)
  misc_feature (71): n=t or c
ccggccatcatttctccacccatcagtcgaaatccgcaccatggggaggttgggtgggcattggtgccagngcacgagcttgacgcggtagagggaggcct

SEQ ID NO: 57933 - DNA, 101 bp, rice(Oryza sativa)
  misc_feature (71): n=t or g
aatagaacatttaattcatagaagtaatcgggatccaagaactcaagaacataacatcaacactaacaganagaacgggtcgacgttagggacggcaccac

SEQ ID NO: 57934 - DNA, 101 bp, rice(Oryza sativa)
  misc_feature (71): n=a or g
taaaaatataaggagttttagggttggatatgagtattaaaaaaatggtagaattaaatgagacgattaanattggtaaaaatatacatgtgtcggatcga

SEQ ID NO: 57935 - DNA, 101 bp, rice(Oryza sativa)
  misc_feature (71): n=t or c
ctaccggcgaacttttcgctctcaggtcagcttgaggggaagtttggatgtcttatatgtatcaacaacangtcgtacaagtacctcaccgcctcaagcaa

SEQ ID NO: 57936 - DNA, 101 bp, rice(Oryza sativa)
  misc_feature (71): n=a or g
gctatatttggttaacattaactattggaggctgttcatccatcgatcagtattccgaaacaggaaaggancccacctcaccacacacggtgattagccac

SEQ ID NO: 57937 - DNA, 101 bp, rice(Oryza sativa)
  misc_feature (71): n=t or g
gttaggatccattgaagctgttgcaagcgaggttgagggaggttagatggaagatcgcaggatcaagaccnccgctctccaatctacgccctcccaggtcc

SEQ ID NO: 57938 - DNA, 101 bp, rice(Oryza sativa)
  misc_feature (71): n=a or g
ttcctcgcgcgcgctggccccaccagcaaaccgccaggctgtcatgctccccttctccaagcaacacgacnaaaccccctcgtcttcctcctcccccgtgt

SEQ ID NO: 57939 - DNA, 101 bp, rice(Oryza sativa)
  misc_feature (71): n=t or c
atcctaaagcatctctattgatggttgtcaccactgctgtagtgcctgggttggtgtcagttaatgtttgnaaatagtctctaatcctcttgtattgcttt

SEQ ID NO: 57940 - DNA, 101 bp, rice(Oryza sativa)
  misc_feature (71): n=t or c
taatatatgcaaatatacatgtgtgtattatggaattctgtgtattataacataactatggagaaacgccnagaggtattccggctagtcccataaagtgg

SEQ ID NO: 57941 - DNA, 101 bp, rice(Oryza sativa)
  misc_feature (71): n=t or c
gacaattaccaaccattttgctccattatatatattgacctagtgctatggactggatatggtaagggtcngaagatcggtgataggacactcacccttgc

SEQ ID NO: 57942 - DNA, 101 bp, rice(Oryza sativa)
  misc_feature (71): n=a or g
cgatgatattgttttgatgcacacgaaattcaagcattttttaactgatcaggtgtaggagaagaagaatncaagtaattcgaaatctgatcgatgaaata

SEQ ID NO: 57943 - DNA, 101 bp, rice(Oryza sativa)
  misc_feature (71): n=a or g
ctccttcctctcccctcttctctctccttcctcttccccgttcaacttcctcttcctccttcctcctcctncatcatggcagtgcttgtcactgcctccag

SEQ ID NO: 57944 - DNA, 101 bp, rice(Oryza sativa)
  misc_feature (71): n=a or c
atttgggacggagggagtatatcgatccccaaatcgctgttgctgatatgagctctcgagattaattgatngattgccatggatgtcgctgcacgatcaac

SEQ ID NO: 57945 - DNA, 101 bp, rice(Oryza sativa)
  misc_feature (71): n=a or g
ggtggccctctctctgcatccacatccccattatcatcccccacctatgaggatctctgtacttgtgtgtntttttagtattctcctcttcttttctatgc

SEQ ID NO: 57946 - DNA, 101 bp, rice(Oryza sativa)
  misc_feature (71): n=t or g
gagcagaaagggcaatattcattcagagtttcagacaactcctacgttcacatcaggtttttgcacaattnacttgtagaagtactcctgaattctcaatt

SEQ ID NO: 57947 - DNA, 101 bp, rice(Oryza sativa)
  misc_feature (71): n=a or g
taagtaaatgaccactaggtctctttctcttccttgattcattggtcccttcattgctaggaagtacttgnttgggttgctgatcatggcgtcctctgttg

SEQ ID NO: 57948 - DNA, 101 bp, rice(Oryza sativa)
  misc_feature (71): n=a or g
gacatctcctatgttggatgtggtgtttgacgtaatgctctcttttacatgcgggttttaccttaagtgtntgtgctaaatttagtgcgtttgtttatgct

SEQ ID NO: 57949 - DNA, 101 bp, rice(Oryza sativa)
  misc_feature (71): n=a or g
ccaaaattcttaatggttgccttcccacacctcttgacaatgtgacagacaactgaccatgtgaaaaaacnggatctagaagatagatcgcaacatttgga

SEQ ID NO: 57950 - DNA, 101 bp, rice(Oryza sativa)
  misc_feature (71): n=t or c
cttttgcccaccccttaaaagggagcaacacgacccaagctataagggtgtgtttggtttgctaccatgtnaaaatattggtattaccaaaacctaggcaa

SEQ ID NO: 57951 - DNA, 101 bp, rice(Oryza sativa)
  misc_feature (71): n=t or c
gaggcagatttgctcatatcatcttggatgttcggccatcctgattataatacgccgcacgctgattaaanctacgatatacagccatacatgttcatatt

SEQ ID NO: 57952 - DNA, 101 bp, rice(Oryza sativa)
  misc_feature (71): n=t or c
taagtacatagcagtgatttaatgaggtaagagtacgtaatcagaagttgaggacgctggcgtagtagggngaccaggtctccatccatgggctccgcagc

SEQ ID NO: 57953 - DNA, 101 bp, rice(Oryza sativa)
  misc_feature (71): n=t or c
cgccccccggatcaccgtcggctactcctaccagatctttcggggaacagatcacgccgcagtctggcggngacactgacatcaatgatggccctgtccgg

SEQ ID NO: 57954 - DNA, 101 bp, rice(Oryza sativa)
  misc_feature (71): n=t or c
gatggtgttttttctcctgcatcactcagttcggctgctgcctgatcgaaatcttccccgatttcttcttnatccaaggcttgctcgatagatggatctaa

SEQ ID NO: 57955 - DNA, 101 bp, rice(Oryza sativa)
  misc_feature (71): n=a or g
aataatctagtgattagtgctagtaactcatgcggtgtttctccccttgatgtttcactatacatgtgtcnttgttcttaaccgtaaaaacgtagtgttgt

SEQ ID NO: 57956 - DNA, 101 bp, rice(Oryza sativa)
  misc_feature (71): n=t or c
tctatttataagtttttttgcatcctcatatcagctgatccctacaccctcaaaacataccatataggcanggatcttgggattagggtataacccatcaa

SEQ ID NO: 57957 - DNA, 101 bp, rice(Oryza sativa)
  misc_feature (71): n=t or c
atggcgttcgtgttgttcagcatgaacacctgcctcatcctcgggaatgcgagctcgccggacttctcctngagcacggcctccaggcggaccgccgggcc

SEQ ID NO: 57958 - DNA, 101 bp, rice(Oryza sativa)
  misc_feature (71): n=t or c
atatcataggcatcattccgtcctaactgggtatcacccgatatctattaaggaatatcaaatactccctncatcccaaaatataagggcccctttgaatc

SEQ ID NO: 57959 - DNA, 101 bp, rice(Oryza sativa)
  misc_feature (71): n=a or c
gttggattggatgatatagatcattggatttgatgaatgaacctgatgtattattcaattttgttcttgcncctgttttgatgtccaatattaattttacc

SEQ ID NO: 57960 - DNA, 101 bp, rice(Oryza sativa)
  misc_feature (71): n=a or g
agtgtcgagccgtcgaggagcacctgctcccctgtggtagtgcttgttattggagttaatccttaaacatntacttaggatatgcatgattacctaatttt

SEQ ID NO: 57961 - DNA, 101 bp, rice(Oryza sativa)
  misc_feature (71): n=a or g
gctctggcaaatgattgtaatcacattgatgagtaatcaataaagcgttcccttcccccgcaaaaaaaatncatgaaatattaaatatatgctaaaaaata

SEQ ID NO: 57962 - DNA, 101 bp, rice(Oryza sativa)
  misc_feature (71): n=a or g
ggaggagtaaagttacaaagaaaaacacgacagaagttgtcaagtacggacgtgcacaaggcacctccaanaaccacacgctaaccacacaagcacaaacc

SEQ ID NO: 57963 - DNA, 101 bp, rice(Oryza sativa)
  misc_feature (71): n=a or g
gaccattttcttcagaattgaacacctcaatttttcaacaaaattctagtacattagcacgctgcctcggnagatttttctcctccgggcaccacaatttc

SEQ ID NO: 57964 - DNA, 101 bp, rice(Oryza sativa)
  misc_feature (71): n=t or c
aaaaaaaatgtacatgaaggtatcgcatagaaccaagcaagtcatattcttcctgtccccacacattgtgnctcctctgccagttgccccatccatccatt

SEQ ID NO: 57965 - DNA, 101 bp, rice(Oryza sativa)
  misc_feature (71): n=t or c
aaaccctatatataatataaacctgaaaactactgtagaattaaaaattgaatctttggttcacgtcatcntgagtaaacttttgctcccagttttaacca

SEQ ID NO: 57966 - DNA, 101 bp, rice(Oryza sativa)
  misc_feature (71): n=t or c
tatcatcagactctctttcacccttaggtttgctgaatttcagtggaaaatttgaactccaaacctctccngtttaagctcccattggttgcccatttggc

SEQ ID NO: 57967 - DNA, 101 bp, rice(Oryza sativa)
  misc_feature (71): n=t or g
gtgttttgcaatcaatggactctgtttaggcagatgggtagtagctgtgttgctaccaaagtgccaagctncatgatcctggaattattatttgggagact

SEQ ID NO: 57968 - DNA, 101 bp, rice(Oryza sativa)
  misc_feature (71): n=a or g
gagtccatgtctccatgagccttgttgctcgctataaattcccatcgcgctcgcgtcttccagtatagtcntcgtcatattttaccctgctttcctctgcc

SEQ ID NO: 57969 - DNA, 101 bp, rice(Oryza sativa)
  misc_feature (71): n=a or g
attaatggcacttgaacttttagttgcgttacacaaccggtgataaccgcgcagtaaccgctccaaaactncgaaatcgtcaattttttaattcaaaattt

SEQ ID NO: 57970 - DNA, 101 bp, rice(Oryza sativa)
  misc_feature (71): n=a or g
gaaggcgaggcatcggcgttgggtgtgttgcctatatctgatctctctcgatctctcgttaatgggctganaaggcagaccattttttactaatgggctta

SEQ ID NO: 57971 - DNA, 101 bp, rice(Oryza sativa)
  misc_feature (71): n=a or g
tccacctggacaagcccggttacagatgggacaacaacaatggcaccgtccctatcaacaggccctttacntggtacaaggtattatataggttgatatgt

SEQ ID NO: 57972 - DNA, 101 bp, rice(Oryza sativa)
  misc_feature (71): n=a or g
atgggcatggataatgtttaatgtttagtaagcaatgaaagaatagccaaatagaactacgatatgacgtngagttacatccctcgttggcgtgctaagga

SEQ ID NO: 57973 - DNA, 101 bp, rice(Oryza sativa)
  misc_feature (71): n=a or g
gcggcgcgggggaaccgcggctacgcggacacgggggatttgtctggtgcgtctgtgacatgtgggacccngggttggttgttttgaattgcgccactgtg

SEQ ID NO: 57974 - DNA, 101 bp, rice(Oryza sativa)
  misc_feature (71): n=t or c
cccaaacctgaaattaagcaggtggcaaccctagtcccaacatgcatataatactaattccaacctttttnctttatgtgagttgtgcagaggagaggaca

SEQ ID NO: 57975 - DNA, 101 bp, rice(Oryza sativa)
  misc_feature (71): n=a or g
acattgctttcagtgagatagtgactacacatatgggacgtatgagaagtatagcctgcctaaaagtcaanttctacatttaagacaaatgggatttcaat

SEQ ID NO: 57976 - DNA, 101 bp, rice(Oryza sativa)
  misc_feature (71): n=t or c
cttctctaaaaaagagcccatgacacgagaacaggtgagcttatcaacacgaacacacacattagcacgtnccttagatctattagagagtctgacgaagc

SEQ ID NO: 57977 - DNA, 101 bp, rice(Oryza sativa)
  misc_feature (71): n=a or g
tgtgtaaaaaaattaaaataaactttgctttaatggcgatatgttttttttcaataaaccctacaattttngtattaatagtgcaaatattttatgttcat

SEQ ID NO: 57978 - DNA, 101 bp, rice(Oryza sativa)
  misc_feature (71): n=a or g
gagttgctgtagaagctacaacagctagcgtttgatgccgatgatgttctggatgaactggactacttccncatccatgatgagctcaaaggcacctatga

SEQ ID NO: 57979 - DNA, 101 bp, rice(Oryza sativa)
  misc_feature (71): n=a or g
aaatatatagctggaacccatttatcatacataaaactaaattgtgggccccgacatgtgggacccatatnccatcctctccgtctttcttcttcatcccc

SEQ ID NO: 57980 - DNA, 101 bp, rice(Oryza sativa)
  misc_feature (71): n=a or g
cgttttggagccgtcaaaaggctgaaaatgccaaggttttcaactatccggagtttaccatggatcacaantcacaacctttctcagccaaggcatcgacc

SEQ ID NO: 57981 - DNA, 101 bp, rice(Oryza sativa)
  misc_feature (71): n=a or g
aacttagaagaaaggaaaacacaaaacatcttatcatcggtttccagttaaaactgaatctaccttcatanaaattcataacctgtgatatgcacacctta

SEQ ID NO: 57982 - DNA, 101 bp, rice(Oryza sativa)
  misc_feature (71): n=t or c
ttccctttataacatttcaatattaccccctcctatttttaatatacaacactactgatttttaacccggngcttaaccgtttattttattaaaagtataa

SEQ ID NO: 57983 - DNA, 101 bp, rice(Oryza sativa)
  misc_feature (71): n=t or g
gatactagcaaccttgtggatggcagaggccgtaggcaagatccattctcgcgtttttgaaaaaaaataanaagaagaatggtaaaatcaatgacttaaca

SEQ ID NO: 57984 - DNA, 101 bp, rice(Oryza sativa)
  misc_feature (71): n=t or c
caatggcaggggcaggcgcatcgctcgaggaaggtaggtcgatcctcgcgacatcaggacatccgccttgntggacgtcctcagaatctacgcagctacga

SEQ ID NO: 57985 - DNA, 101 bp, rice(Oryza sativa)
  misc_feature (71): n=t or g
aacgaacatacattcggcctctacaggacactagatctacacaaaaaacagatcacgtagtgagctacaanttttttttcatcattcatcaaatttaccgt

SEQ ID NO: 57986 - DNA, 101 bp, rice(Oryza sativa)
  misc_feature (71): n=t or c
tgtatgagcaacaaaaaggaagaagtccgacgtggagaagtcctctgcctgctgtaagtggagaagtttgntcgctcgccggatccaaggagagagggaca

SEQ ID NO: 57987 - DNA, 101 bp, rice(Oryza sativa)
  misc_feature (71): n=t or c
agacgtttgcaggccatccggcccattaccgccgtcccaaaatacttatttttgagtttttattaccaatnatcttgtttagaagattatataattattat

SEQ ID NO: 57988 - DNA, 101 bp, rice(Oryza sativa)
  misc_feature (71): n=a or g
ttaacagctctgtttgattagtaggaatgattgtcaggtacatcaaccagtttcaaatgcctaaactgatncaacctgtttatcttaatctctcctattgc

SEQ ID NO: 57989 - DNA, 101 bp, rice(Oryza sativa)
  misc_feature (71): n=a or c
atccgaaagtagaaagaaccggagtactactgaatctttcccgtatcggatttgagtcggagtacttgctnaaaaattctttaaatcgggcgcccgcgcct

SEQ ID NO: 57990 - DNA, 101 bp, rice(Oryza sativa)
  misc_feature (71): n=t or c
actgcatctggatctccatgttgccatccatgtcctcctctcatcctgctgctgctttgctgttttttccngctccatgtatctgtctctgtccctttctt

SEQ ID NO: 57991 - DNA, 101 bp, rice(Oryza sativa)
  misc_feature (71): n=t or c
acaatgatctcctcggtaaccttgggatcagttgttctctcttataatttatggatttctatatcaatctnatataaactcgattatggctattaccttac

SEQ ID NO: 57992 - DNA, 101 bp, rice(Oryza sativa)
  misc_feature (71): n=t or c
gttcgccgctggtcgtggacacgatttgtatactacgtagtggcgaacaaaaccaatccctctcgatcacngtgcagttgaagatttcccgtgccatgcca

SEQ ID NO: 57993 - DNA, 101 bp, rice(Oryza sativa)
  misc_feature (71): n=a or g
ctagcagaagtatacttaccatcagcgttcacaaatagagctcgccgatttggacagtcacatgcaatgtntccaatgccatggcacctatgacatgtagt

SEQ ID NO: 57994 - DNA, 101 bp, rice(Oryza sativa)
  misc_feature (71): n=a or g
gcagcccacccgcttccatagaacaatatcgcggcaacgtattgactaagatgagccaattagatgttggngaaaactatttatctcggcgctatcttgcg

SEQ ID NO: 57995 - DNA, 101 bp, rice(Oryza sativa)
  misc_feature (71): n=a or g
gctcctccttgctggaagccagcggttcccctaggtccgggaaagaagaaagagaactagtgtatggagcngcggcatagtcactagatttggaggtggag

SEQ ID NO: 57996 - DNA, 101 bp, rice(Oryza sativa)
  misc_feature (71): n=t or c
taaaccaatcatagagtcaaattattatcacaggctatcaaataaatcagggtaatcaaaaggctaagtangggtaaattccatcccacatgacattataa

SEQ ID NO: 57997 - DNA, 101 bp, rice(Oryza sativa)
  misc_feature (71): n=a or g
acaactagctgtgctgtgcatacatgaactcttttttacttgaggggcagactcctttactagaatgaagngttgccaagttttcggtctcacgccatcca

SEQ ID NO: 57998 - DNA, 101 bp, rice(Oryza sativa)
  misc_feature (71): n=a or g
aaattcataccttcaaggcaacagcaacagcagcttgctcgggtgtcatctcactgaatggtaccaaagcngtcaaaatctcccacaagacaattccaaag

SEQ ID NO: 57999 - DNA, 101 bp, rice(Oryza sativa)
  misc_feature (71): n=a or g
ttgagttgaggaaggagcatgcacatgacattgatggatatcaaagaggagttgcagtttggagagctgcnggtgtttttcagttttgtgaggagtagccc

SEQ ID NO: 58000 - DNA, 101 bp, rice(Oryza sativa)
  misc_feature (71): n=t or c
tttttatttataagtgccaatagatcaccgagggtttcgataaagatgtcactctcgttaagttcaggggnaggggtagaatgaaattgagaaggatacca

SEQ ID NO: 58001 - DNA, 101 bp, rice(Oryza sativa)
  misc_feature (71): n=t or c
cctctacgcaaaaaaaaaaaaaaaatcaattccaaattgccaatgtgcagcagccatcagccatggtgcgnagtagtataggtgggcagcgtccacgtcaa

SEQ ID NO: 58002 - DNA, 101 bp, rice(Oryza sativa)
  misc_feature (71): n=t or c
agaacagccgggagggtccattatgcatgcaatgtcagtttggactggaatcggtcgtacattaattactncttccgtctctctccgttttaaaataaaca

SEQ ID NO: 58003 - DNA, 101 bp, rice(Oryza sativa)
  misc_feature (71): n=t or g
acgagggttttttttttccttcacagtgtagatctcgttcttttctcagagtctaacagttcggtgtaatngtgggatgaaaatgtatgtgacatgagtct

SEQ ID NO: 58004 - DNA, 101 bp, rice(Oryza sativa)
  misc_feature (71): n=a or g
tgcggatatgatggcattgtaagaatgatgatgtggtcacgaacaataggtggtggccttatttagttggngaaaatttattaagccaaaaatgtttactg

SEQ ID NO: 58005 - DNA, 101 bp, rice(Oryza sativa)
  misc_feature (71): n=t or c
cataaggcaggttaattaacataggctagaatttacaggtgcaacagttgataagataggcataagcaagnaaaatatcctgaaagctatgctatgtaatc

SEQ ID NO: 58006 - DNA, 101 bp, rice(Oryza sativa)
  misc_feature (71): n=a or g
tagccatgcccctcaagactagcgtcgatcacaattttaacacctattattgtctacacacttataaaaanaatgtattagtaagtaggctagttgagttc

SEQ ID NO: 58007 - DNA, 101 bp, rice(Oryza sativa)
  misc_feature (71): n=t or c
tgccaacagggtcgaacaataagatatcatggggttgtgatgtcaaggagatggttcaattgtagtgtagnagcgatgtaactataatataaattggatgt

SEQ ID NO: 58008 - DNA, 101 bp, rice(Oryza sativa)
  misc_feature (71): n=a or c
catctcttacacacatactccctctgtttatataattaattttatatatgtttgattttttcagacggggngagtactgttttagagtggtgatgtagcta

SEQ ID NO: 58009 - DNA, 101 bp, rice(Oryza sativa)
  misc_feature (71): n=t or c
aatatttaatatggatggagtataaattagtcagccatgccgcggccagatcaagccactaatctatctcntcccccacggatcggcaaccagagctgctc

SEQ ID NO: 58010 - DNA, 101 bp, rice(Oryza sativa)
  misc_feature (71): n=t or c
ttctcgctgctctgcctcttccttgtgcctcatcaccctggtgttgaaaggaagaaggtgttagaagtagngatagttcagagatatgcatgcatgcatat

SEQ ID NO: 58011 - DNA, 101 bp, rice(Oryza sativa)
  misc_feature (71): n=t or c
tcgtgcttgcgctgaattcggtttcatgaccatgttaccgtactatgcatgcactagctatacctacctgngcgaagaagctacgtgatgcgcgttgcatg

SEQ ID NO: 58012 - DNA, 101 bp, rice(Oryza sativa)
  misc_feature (71): n=a or g
acgactacgtcttctctctgtccgtctgtgcaggccacccgtgacgacagaaaaaagaggaaattaggaanagaggtgaaatgcatcatctgtgctgggat

SEQ ID NO: 58013 - DNA, 101 bp, rice(Oryza sativa)
  misc_feature (71): n=a or g
accaggtttttgcacagtggtcttcttcagctcagctcaactcatacacagaaaccctaagctctgtaggntctgtttgggagccttagattctgataaat

SEQ ID NO: 58014 - DNA, 101 bp, rice(Oryza sativa)
  misc_feature (71): n=t or c
taggttattacaacgacatcacatctcacttgctgataatggtaccagtatttagttactacctccgtccnaaaataagtgcagccgtggatatccgtgcc

SEQ ID NO: 58015 - DNA, 101 bp, rice(Oryza sativa)
  misc_feature (71): n=a or g
ccacaggacagagtatccctaccaggctgacaaggaatgtttagtttcagcccatagaattttctatttcngtcctcataaaccctaaatttataaataaa

SEQ ID NO: 58016 - DNA, 101 bp, rice(Oryza sativa)
  misc_feature (71): n=t or c
aaggatctgtactagtgaaaaatagtgtggtgatgcactaacacgagcggcactgaattgcttttacgatngtcggtgccacgcaaaatttggccaatcaa

SEQ ID NO: 58017 - DNA, 101 bp, rice(Oryza sativa)
  misc_feature (71): n=a or g
tttccgccttccgtaaaaaaaggaaaaaaatagtgcaaacaaaatgtccgattctaaacaaaaaaatcccntcctccgagcccccccaaaaaacaagcgtg

SEQ ID NO: 58018 - DNA, 101 bp, rice(Oryza sativa)
  misc_feature (71): n=a or g
ctatgcgttttgttgcggttttctaggcagtgaccctataccaataccaagttactcctacttgatgaggngcattgctcgtataattggttggctagaca

SEQ ID NO: 58019 - DNA, 101 bp, rice(Oryza sativa)
  misc_feature (71): n=a or c
catgagcatcttcttggagaggttggaggacacgcaaaagcttcacccccaaatgaaggattggagggatngagtacgcgagttggcatacgacattgagg

SEQ ID NO: 58020 - DNA, 101 bp, rice(Oryza sativa)
  misc_feature (71): n=a or c
aaaaaaaaaaaaaatctatcgatccatcttgatctcccgtacaaaaatcgcgacggccctcttagcaaagncaaaaaaacagaaaaatgtcgaaagaaaat

SEQ ID NO: 58021 - DNA, 101 bp, rice(Oryza sativa)
  misc_feature (71): n=a or g
gggagggaaaaagaaggaaggaaatggaggaaaagaacggtggagaccaaaacctcaatgaagcgggactngcggaccagtcctgcgggaagcaatgaagc

SEQ ID NO: 58022 - DNA, 101 bp, rice(Oryza sativa)
  misc_feature (71): n=t or g
gacaaatggacatcaatgttaatttgcatgtattacttgaaatcagcgtaaaccaagagcatcaccaaganatgttcaaaaatctatccccaaattttatt

SEQ ID NO: 58023 - DNA, 101 bp, rice(Oryza sativa)
  misc_feature (71): n=a or g
tttttctagatttttaaaataaagttaagagcaggcactcacacacgcacaatcatccttacgaatgcacncacaccccacctttacaagcactttcagaa

SEQ ID NO: 58024 - DNA, 101 bp, rice(Oryza sativa)
  misc_feature (71): n=a or g
tgggatattcattgttccatatgcaataccatcagttgctgacctttctgaagctgaaggatgagcaacanagatctgccccagttgacatatagcctgat

SEQ ID NO: 58025 - DNA, 101 bp, rice(Oryza sativa)
  misc_feature (71): n=t or g
gataccaaccacctaaccacatgaagcgagcacaaaagctcattttcgacaaccccgatatcagagcaaanactcgatataaaacggagggaatagtaaat

SEQ ID NO: 58026 - DNA, 101 bp, rice(Oryza sativa)
  misc_feature (71): n=t or c
aactaacttgatttgatacatgcacgcgtattacgcgtactctcctttgattctttgacccatatctaacnctgcttgcaacctatcaatgcaatgtgctg

SEQ ID NO: 58027 - DNA, 101 bp, rice(Oryza sativa)
  misc_feature (71): n=t or c
ccaaacggcctgccttcatgagatcctccaggtcgctcacatggaacaccaaacgtctcctcttgtttatnctgatgaaagagagatattgaactatatgc

SEQ ID NO: 58028 - DNA, 101 bp, rice(Oryza sativa)
  misc_feature (71): n=a or g
gaggtgaggattcgatttcgaggtcttcccgttaattggtctagattacttagcgcaatggattggcatangccatagggaggacgagctcacttagtttg

SEQ ID NO: 58029 - DNA, 101 bp, rice(Oryza sativa)
  misc_feature (71): n=t or c
aattttcggaatgagcttccctcctttggttcatgaagaatatcgtttagaaaagaagttcttcttcatangtgtagaatgaaagatcctttaaagcagat

SEQ ID NO: 58030 - DNA, 101 bp, rice(Oryza sativa)
  misc_feature (71): n=t or c
atgtcagcaaaactaacaccatatttgaaatagatcgcctggagaggattccactgccaaccatgtctagnggtccatcagcacgataaaagagttatgac

SEQ ID NO: 58031 - DNA, 101 bp, rice(Oryza sativa)
  misc_feature (71): n=a or g
ggaaggctgatggaattaagacgatacctccattcggaattggagtagtagcaggcttctcatcgtcgttnaacgccatcctgaacctgactgctaagatg

SEQ ID NO: 58032 - DNA, 101 bp, rice(Oryza sativa)
  misc_feature (71): n=a or g
aactctgatgcaggctgctgacgataggttacagggtgcgttcgacgagacgcagatggagcgtgtgatcntcttggggctgtggtgttgtcagcccaata

SEQ ID NO: 58033 - DNA, 101 bp, rice(Oryza sativa)
  misc_feature (71): n=t or g
tggatcggttgagattgtttggggatgatacactatgtatggggtcctgaacaattttctcacgtgtttgntgttcagcaagcaactgcacctgttggaat

SEQ ID NO: 58034 - DNA, 101 bp, rice(Oryza sativa)
  misc_feature (71): n=t or g
gttcaatctccatagatatcctcgaaaattcctgcttttgcaaacaaccaaccctaaacgccaagccatgnatcgcatccccctcatccatctcattctca

SEQ ID NO: 58035 - DNA, 101 bp, rice(Oryza sativa)
  misc_feature (71): n=t or c
aaatttttccacgaggatggtcaaaccatatgaaaaataaattttcacatgcgacaaggtatgcggctcanaaaaaacaaaatttggtaaaaataattaaa

SEQ ID NO: 58036 - DNA, 101 bp, rice(Oryza sativa)
  misc_feature (71): n=t or g
cagtttggttgaaatggatgaggatcaaggggtactatacctgcatgctgtcgtaaactcgtaatcagctngccaggcaatataatgcaaggttgatttaa

SEQ ID NO: 58037 - DNA, 101 bp, rice(Oryza sativa)
  misc_feature (71): n=a or g
gaaaaaaatagccttcagggatcaggattctggtagtaataagtagagtagtagatcgagaaacacacggnggtcttccagctagctccgcaaagtggtgg

SEQ ID NO: 58038 - DNA, 101 bp, rice(Oryza sativa)
  misc_feature (71): n=a or g
taacatcagggttaacactgccaatgagagaactggtggcttccgtagtgggggtggtggctatggaggcngtggctatggcggcggcggtggcggctatg

SEQ ID NO: 58039 - DNA, 101 bp, rice(Oryza sativa)
  misc_feature (71): n=a or c
aagtgcaaaaacagaacatggaggggagcgacaaaaatgctggccatcaaatccttcacatgtatggtgcnctacttttttagaaacaaacacttcgtgtg

SEQ ID NO: 58040 - DNA, 101 bp, rice(Oryza sativa)
  misc_feature (71): n=a or g
cagcgaaaccgaccttgctgcactgctggctttcaaagcgcagctgagtgatcctctcagcatccttggcngcaattggacagtcggcacgccattctgcc

SEQ ID NO: 58041 - DNA, 101 bp, rice(Oryza sativa)
  misc_feature (71): n=a or c
gggtccgacgacgtgtcggcgtggctggtgtagtcggcgatctcgagctgcttgtggttctcgccgtcgcnggcgaggatcttggcggcgctgtcgacggc

SEQ ID NO: 58042 - DNA, 101 bp, rice(Oryza sativa)
  misc_feature (71): n=t or c
tcaagattagaatgctctcagaaactttgaaatagatgtgcatgccaaaggaggtatattgctccttagcnttataagctaaagcattatgccatataaac

SEQ ID NO: 58043 - DNA, 101 bp, rice(Oryza sativa)
  misc_feature (71): n=a or g
gctctaaggatcacaaaagatctctacatatgtacaataatgtgactcaccattaatcaacacttatcaantttggttattgaattattttgtgaattctt

SEQ ID NO: 58044 - DNA, 101 bp, rice(Oryza sativa)
  misc_feature (71): n=a or g
tacttcatgcgcttacctctaggagcactaaggaattttcgatccagtaacactgaaaagaagatatgatntttctttatagcagagcataatcttttttt

SEQ ID NO: 58045 - DNA, 101 bp, rice(Oryza sativa)
  misc_feature (71): n=a or c
gtggcattgctgtatcaatggtgatgaaatatgctgacaatattgtcaaggtacaaatgctgaacttctanagctggcttagaattcaaccatgttgcatt

SEQ ID NO: 58046 - DNA, 101 bp, rice(Oryza sativa)
  misc_feature (71): n=t or c
cagctgcctatatgtcctcgcatatcgacaaaccataaggtttccgttgccctcagttaccatgaccgcgngaatctagatgggatcaacacaatcgaatc

SEQ ID NO: 58047 - DNA, 101 bp, rice(Oryza sativa)
  misc_feature (71): n=t or c
aaacgctcacaacatgtgcacatttacccttataaacgtacacacccacggtctgttcttgtgagtatctntgaaagatcaagccaatatactttgagatt

SEQ ID NO: 58048 - DNA, 101 bp, rice(Oryza sativa)
  misc_feature (71): n=a or g
ttggggcactagggtgcaacctgatgggtgtccagtgctcctctttttttaaaaacggatttgctatactnctgtcgacagttaacagggggtgaaaactt

SEQ ID NO: 58049 - DNA, 101 bp, rice(Oryza sativa)
  misc_feature (71): n=t or g
accaacacaactctcagtttcacctctcagagtttgactaaacccttaattatggacctcttgggtctcancttcatgctaagttttgttctcctcttctt

SEQ ID NO: 58050 - DNA, 101 bp, rice(Oryza sativa)
  misc_feature (71): n=t or c
agattcttgtcgccttccacttatttggaccagttggattcgccatgcccaactgccatcgccgttcgatntgtcgaaaaccgccacctgtaagaggagca

SEQ ID NO: 58051 - DNA, 101 bp, rice(Oryza sativa)
  misc_feature (71): n=t or c
cgcagcaatgataggagcatgcagaaaacagcttgttcatcagatgagcatgtctagctgccactgataanataagccacagtatgtgttcaggccttcag

SEQ ID NO: 58052 - DNA, 101 bp, rice(Oryza sativa)
  misc_feature (71): n=a or c
gcaagtgaaaatgaggcagttgctgctagtgtgcatagcacatagtgagctggcatttttaagagcttganatggttctttcatcagaagtcacttttaaa

SEQ ID NO: 58053 - DNA, 101 bp, rice(Oryza sativa)
  misc_feature (71): n=a or g
tgttgttccgctcacatcaagatcttgagcttgagcagtccggcatctctctcttgtttctcatcaatctngtgccggctatgattagaaacaagaagaga

SEQ ID NO: 58054 - DNA, 101 bp, rice(Oryza sativa)
  misc_feature (71): n=t or g
tttgaagcgtgaggaagttacagtcaagtcactccatgagttgtggtgcagaatcaaagttccgctgaganactcttataatgatggtgcattttatcatg

SEQ ID NO: 58055 - DNA, 101 bp, rice(Oryza sativa)
  misc_feature (71): n=a or g
gatcaaggtggtaaacggatggagcaatgcgatggcagtgttaatgaaatatggagtttttgagagtgaangccattgaaatactcaatcaattgaataga

SEQ ID NO: 58056 - DNA, 101 bp, rice(Oryza sativa)
  misc_feature (71): n=a or g
acatacttgaatgtttctttccttcttcaggctgaccgtaaagttgggaaaaatcatctgttcaagaggancattatgctaatcaaggcttggtgttatca

SEQ ID NO: 58057 - DNA, 101 bp, rice(Oryza sativa)
  misc_feature (71): n=t or g
ttatttagaaattcaggcacacaggaacaagtaaactaacagagttgagtgaacaaagcaagcaaaaacanattttttttttcttctgataacttgatata

SEQ ID NO: 58058 - DNA, 101 bp, rice(Oryza sativa)
  misc_feature (71): n=t or g
tctaagtgagcctggcccaaatgcattcatcggcccaatttcacgctttttcaacctctagctatccaganacctagcgcacctcctactctatcatccat

SEQ ID NO: 58059 - DNA, 101 bp, rice(Oryza sativa)
  misc_feature (71): n=t or g
aaattatctctcttttttcccccaagaaatatcgtttgttaaaatgatgtccgggctattttctaccattntgatctttgcgatagtatcaagcaaaatga

SEQ ID NO: 58060 - DNA, 101 bp, rice(Oryza sativa)
  misc_feature (71): n=t or c
agaagaagaagaaaaagaagggcggctttactgtggacaatgaggacattgacaagctcctcgccgagatngacgatacttctcctcccaccgaagaggct

SEQ ID NO: 58061 - DNA, 101 bp, rice(Oryza sativa)
  misc_feature (71): n=t or c
ttgaacgactaatatgaatgtattgatgtttcattgcagtttggagatccacgtgtacttgcaacatttcntccgtgctttttctgatgtttttaccgtga

SEQ ID NO: 58062 - DNA, 101 bp, rice(Oryza sativa)
  misc_feature (71): n=t or c
aagatataggatccttggttcatttgacttggacgctctaaatgtttcatgtcgtacactttgcacacttnttctggatttatcttggcgaactgataatg

SEQ ID NO: 58063 - DNA, 101 bp, rice(Oryza sativa)
  misc_feature (71): n=t or g
gtctgtacgtcttgtgttcataatcaagggggtccaggaccacaacgctcccatacattgggtagagcaanaaacatatataacgatcgctaaatagtaac

SEQ ID NO: 58064 - DNA, 101 bp, rice(Oryza sativa)
  misc_feature (71): n=a or g
ccttttcttcaattcgcatgtaaacaaaatacataaatgtgaaagtgccaagagcctcagtagcacctgangtcctgggttcgactccccatgggagcgaa

SEQ ID NO: 58065 - DNA, 101 bp, rice(Oryza sativa)
  misc_feature (71): n=t or c
gattttcacccggataaagagagagccacttaatgatgacttcaaggaggaagacgacgcccacaagcacnaatgttgccaacaccagtcagagaccgggg

SEQ ID NO: 58066 - DNA, 101 bp, rice(Oryza sativa)
  misc_feature (71): n=a or g
gccgacttgtgattggaggcagagctcgaaggtgtgttagttgatatcaattctttgcttgcatctctcantgaactgctctttccatcccggcgtggatg

SEQ ID NO: 58067 - DNA, 101 bp, rice(Oryza sativa)
  misc_feature (71): n=a or g
taaccgaattgaccgaaaaccgaaatacagcattagcccattaggcccaatacctcctcagcaaaagcaanaccttatccaacccaccaccaccagcatcc

SEQ ID NO: 58068 - DNA, 101 bp, rice(Oryza sativa)
  misc_feature (71): n=a or c
agtttttttttattgatctttgatgacaaaacaaatacgtatgacactttagcatcttgtttcataaaaanctaacctttttggtactagattgatttttt

SEQ ID NO: 58069 - DNA, 101 bp, rice(Oryza sativa)
  misc_feature (71): n=a or g
aaaggcataatacatttcactttgaaatagccacataggtcactggaaatacagaagggtctccttattcntgacaattttctcgcacgcgccttttggtc

SEQ ID NO: 58070 - DNA, 101 bp, rice(Oryza sativa)
  misc_feature (71): n=a or c
tgctcacttcttatcaccttcgtcgcgtggaaaagaacaagccgttccattataaccgttccatatgcttntttttctccatcgttgttttgcacagataa

SEQ ID NO: 58071 - DNA, 101 bp, rice(Oryza sativa)
  misc_feature (71): n=a or g
acaacttcatatcgagattatattgatgacgtctagtcgtctaccagtggaaagagatactaaattgcatnagctagaacattgtcaatgaagttatccag

SEQ ID NO: 58072 - DNA, 101 bp, rice(Oryza sativa)
  misc_feature (71): n=a or g
gtcatctccgatggaaacttaatcttgatagcgaaaaaataaaacagttccagctggtcatgtatgcagcngatcccttcgatggcagattccatctcgtt

SEQ ID NO: 58073 - DNA, 101 bp, rice(Oryza sativa)
  misc_feature (71): n=t or g
tcgggtcgggcatggattatctgtaggcaaaatataaaacctatctgcgcccactaagttcgctggtatcngatcaggcgtgcccacagacaaaaaaaggt

SEQ ID NO: 58074 - DNA, 101 bp, rice(Oryza sativa)
  misc_feature (71): n=a or c
tacacatgagaaaacaatcagtaccatagtttaaacatttaaattagcctatggaggatgtgcttcggcgnctaggagtgcctgtccatttctgaaagtgg

SEQ ID NO: 58075 - DNA, 101 bp, rice(Oryza sativa)
  misc_feature (71): n=a or g
gacacccaatgttgtggcggggtgacatcagatggccttctcctccttgtcgtcgtcgttctcacccgtcnccgagctcctcgagatgccgaacttgagca

SEQ ID NO: 58076 - DNA, 101 bp, rice(Oryza sativa)
  misc_feature (71): n=t or c
atagtaatcctaattgtccgtgcatcggattggattactgaccagataggttgaatagatgctactccctncatttcaggttgtaagatgttttgactttg

SEQ ID NO: 58077 - DNA, 101 bp, rice(Oryza sativa)
  misc_feature (71): n=a or g
ttcacgtgcatatctactgttgttgctacatcgtcggttcgcgtcaaacagacatatatagtacgtggcantaaaaacacatcaaagcatttttttttctt

SEQ ID NO: 58078 - DNA, 101 bp, rice(Oryza sativa)
  misc_feature (71): n=a or g
ctctcaattcaccatctcacgcaaatccagcgtaattcaccacaagtgattcagcccctgctcaaaacttngcggcgattcgggaccaagcccgctgccgc

SEQ ID NO: 58079 - DNA, 101 bp, rice(Oryza sativa)
  misc_feature (71): n=a or g
gaatattttgaccataatgaactgtagtttgtgttagtcttttcgcagaaatttaattagtttcgttcagnatcttgagatagataaattcgacatttttt

SEQ ID NO: 58080 - DNA, 101 bp, rice(Oryza sativa)
  misc_feature (71): n=a or g
aactacacaaataccgcatgataactgtagagctaaagaaacatcaaagattgaaggtttaacatgatgcnaacttaattttggtctcaccctaatgtagg

SEQ ID NO: 58081 - DNA, 101 bp, rice(Oryza sativa)
  misc_feature (71): n=a or g
agatgaaaaattaccaccttgccctcatctttttcctatcgcatacccaatcttggaggagatggaggatncggagaagcaataacggaggatagggctgc

SEQ ID NO: 58082 - DNA, 101 bp, rice(Oryza sativa)
  misc_feature (71): n=a or g
taaatcaaacgcagcctgcaggagtacatgcgaaatcgtgaatcagaatcactacattactgaagaagatnagcttgccggagcgcatacgaatcactacg

SEQ ID NO: 58083 - DNA, 101 bp, rice(Oryza sativa)
  misc_feature (71): n=t or c
caatctctctctctgtcgtgcctatataaagcctcccctagccatcctctacctttccctcaagtcccgantgccgcctcagccctagcgccgccgccgcc

SEQ ID NO: 58084 - DNA, 101 bp, rice(Oryza sativa)
  misc_feature (71): n=t or g
accattgcaacgtatcctgacatttgctattgtctccggtggcggcatggtgatctgtgcctgagtcgcangattgacaaggagcagattagaccgctcca

SEQ ID NO: 58085 - DNA, 101 bp, rice(Oryza sativa)
  misc_feature (71): n=a or g
tgatagatcagtctgaaccgacgaaagcagtgtttaggagcaggtacgcctctgatcatcagtgtctacanttcaaaccctgtatatccgcatatataggc

SEQ ID NO: 58086 - DNA, 101 bp, rice(Oryza sativa)
  misc_feature (71): n=a or g
agtagttagtgatgaattaactcacttcaaattcatcaagatgtgctgtagcatcaatggagatgtttgcnactattgtactcgatgctttcctgaaccac

SEQ ID NO: 58087 - DNA, 101 bp, rice(Oryza sativa)
  misc_feature (71): n=a or c
gattccagcaatcctttttttaaaactaaaccccaaccaccaaaggggactaaccccccacccccaaaatncaatgaacaagacggcgacaccaagcatgg

SEQ ID NO: 58088 - DNA, 101 bp, rice(Oryza sativa)
  misc_feature (71): n=t or c
ttgacacgggttatcgtatttacgactatttttctttcagtggtagacgacgtgctcttcgactgcgagangtctgtggtaaaaaaaaaatctcccaattg

SEQ ID NO: 58089 - DNA, 101 bp, rice(Oryza sativa)
  misc_feature (71): n=t or c
caaagttaaaacattgatattcaatagtgataagagtttcccttaccatttgagggggttatccccctggnggtaaggcggttacccaaaaaccacgtgaa

SEQ ID NO: 58090 - DNA, 101 bp, rice(Oryza sativa)
  misc_feature (71): n=a or g
gcaatcatattacaaacccatgaatgtagtgtagcctcatgttgtacccaatactcaataaacaatgggcnacctagctaacatcagtaatccaattaaaa

SEQ ID NO: 58091 - DNA, 101 bp, rice(Oryza sativa)
  misc_feature (71): n=a or g
tatatatatatatatatatatatatatatatatggcgagtgatcaacgcagtgtagggagattgtcgtacnaggggtcgggaagaaggctcaactacaatg

SEQ ID NO: 58092 - DNA, 101 bp, rice(Oryza sativa)
  misc_feature (71): n=t or g
tgatttgcaagaattgggtattaggaaggatcaacatctattggtccataaaggaaaatacactttgccantagccttgtacacgttaagtccaagtcaga

SEQ ID NO: 58093 - DNA, 101 bp, rice(Oryza sativa)
  misc_feature (71): n=a or g
ggctgggagaaggagcgtcgcggcaattgatgagggaaaaggaggcgatgtgtgccacctccaaatgatgncccatacgagttagcttgggtgatcggcca

SEQ ID NO: 58094 - DNA, 101 bp, rice(Oryza sativa)
  misc_feature (71): n=a or g
tttttcagctatatatgcagagttacagcgccttatgttttggcgtttattcggttggcaacctatacacncgaatgaatagataacaatcttagtgatga

SEQ ID NO: 58095 - DNA, 101 bp, rice(Oryza sativa)
  misc_feature (71): n=a or g
ggtcttgatgagatcatcttcattcctgcccaacttcctgaacgaagtatatggcactagattcacagcanccccaccatgaaccatcatcttggacatcg

SEQ ID NO: 58096 - DNA, 101 bp, rice(Oryza sativa)
  misc_feature (71): n=t or c
tcgccaccgtgcgtttgggggggggggagtggaaagagaagtttatgtaatatatttttcgtgtgacttangtgtggatcccacattatttttattatctc

SEQ ID NO: 58097 - DNA, 101 bp, rice(Oryza sativa)
  misc_feature (71): n=a or g
cgacccacttcgcaattctaccgatgatatctttattcctgacgacttctcccaggggaaaggatgagacnaccgtcactttgtgggcctggaagtagtga

SEQ ID NO: 58098 - DNA, 101 bp, rice(Oryza sativa)
  misc_feature (71): n=a or c
aagctgataaggcctcatagacaaggggtttgagacattgtgagcctaaaaaagcactagaaacactaganctagacattttggatagacagaggtgcata

SEQ ID NO: 58099 - DNA, 101 bp, rice(Oryza sativa)
  misc_feature (71): n=a or g
tttatttttctttttctcagaaatatcggggatttaatcttatttgtgtaaatagctgggagaccgagcgntcggtctagcttgctcaaccagcgagaccg

SEQ ID NO: 58100 - DNA, 101 bp, rice(Oryza sativa)
  misc_feature (71): n=t or g
tttgttggataaatgggtaccctggttcccatttcaccgacaccgtgctttgctatgataaaataaattanatgtgtactaatattgcttggaacaaatta

SEQ ID NO: 58101 - DNA, 101 bp, rice(Oryza sativa)
  misc_feature (71): n=t or c
gaaccggctcaaattctacatcagtcatgcacaggtttgtgacactaactcaccaataaatactggtccanttgcacctctcactcacataccttctcttt

SEQ ID NO: 58102 - DNA, 101 bp, rice(Oryza sativa)
  misc_feature (71): n=a or c
accggctggacaacaccggttagaccggcggcataggaactgtcagaccgatgagcacactgcgatcagantggctacgccgagatcttcatcaactatga

SEQ ID NO: 58103 - DNA, 101 bp, rice(Oryza sativa)
  misc_feature (71): n=a or g
cctatcttgtactgcaccacattcgtctaccctttacattttctcatccagccatctgaaagaccttggtntcatagatggcacggttcgtagtctcgcgg

SEQ ID NO: 58104 - DNA, 101 bp, rice(Oryza sativa)
  misc_feature (71): n=a or g
gcttgtttactactactcccaattgactagccacaggagctttttttcatcagataatatctgctgtcganaagtgctaattttgctatgcttaaaaagtg

SEQ ID NO: 58105 - DNA, 101 bp, rice(Oryza sativa)
  misc_feature (71): n=a or g
ataggcatgaatgcatgccagtagagtgaaggccctaacacttttgcatggggaaaattgtcgtctattgntttacaatgatgcgtatattggtcgtgcga

SEQ ID NO: 58106 - DNA, 101 bp, rice(Oryza sativa)
  misc_feature (71): n=t or c
tacataaattaacctaagagatgacttggtcgctcatcattgattttttttcccttgtgctatagctcctntaggacctatggatcattggaataattgta

SEQ ID NO: 58107 - DNA, 101 bp, rice(Oryza sativa)
  misc_feature (71): n=t or c
ctaagcgtcttattagcttttggctataaattaagtctatttggtcctaatcgtacactgctggagaaacnatctttggtcggtcgaccaaattccacaat

SEQ ID NO: 58108 - DNA, 101 bp, rice(Oryza sativa)
  misc_feature (71): n=a or c
actaaagtacagcataaagagatctactgattaatcaaatttacagaaagcaataagcccaagaacatgtnaccaaaagggataaactccggtaagattca

SEQ ID NO: 58109 - DNA, 101 bp, rice(Oryza sativa)
  misc_feature (71): n=a or g
gtcatctagcatgtcttaaatgatcaatgactgaagcgattgataaagttagttgtcgttccgttttaccnactaacatttataatattaaccacaaaact

SEQ ID NO: 58110 - DNA, 101 bp, rice(Oryza sativa)
  misc_feature (71): n=a or g
tccctgtcttgtgcatttaaaggtttcatttgtacttcagagctcggtatttcagccgaagttaacgaggncaagcaaatataagcccgtgaaattcaagg

SEQ ID NO: 58111 - DNA, 101 bp, rice(Oryza sativa)
  misc_feature (71): n=a or g
gaacttattccttctagattttagatcctatagagcccatccaggatgtgaggcccacgtgtggccatctngccctagcaatataatgtgggctagaggat

SEQ ID NO: 58112 - DNA, 101 bp, rice(Oryza sativa)
  misc_feature (71): n=a or g
atacataaggagacaccgccactgtgttccatactcccatacaccgccccagtgttccatgctcccatacncagtgttacaatttaaccaatgacacaaga

SEQ ID NO: 58113 - DNA, 101 bp, rice(Oryza sativa)
  misc_feature (71): n=t or g
atcacaaataatgaccacagtttattcgcaggctattcaaccattcgactatggcataagtactgcctccnatccataatataaatatttttagagttggg

SEQ ID NO: 58114 - DNA, 101 bp, rice(Oryza sativa)
  misc_feature (71): n=t or c
tatgtttttctaaaaataatttctatataaccttttttaatatacaatgcttagatgttcggaaaacgtangtgcgaaagacgagggagtagaaattaagg

SEQ ID NO: 58115 - DNA, 101 bp, rice(Oryza sativa)
  misc_feature (71): n=a or g
agtttcagaaacctgggctctcctctgcatcagccggccgaacacgtcgggcacaggaattttgtggggantaagtccactttgactcccttaaaagtgac

SEQ ID NO: 58116 - DNA, 101 bp, rice(Oryza sativa)
  misc_feature (71): n=a or g
gacgccttaactatccacttaattagaactagacttcttcttatgggccaaacactgatgggccttatggncatacccaaaacagaaactgcatctaactg

SEQ ID NO: 58117 - DNA, 101 bp, rice(Oryza sativa)
  misc_feature (71): n=a or g
aattcaatctacgaactttcaagacatcttttaatttgtgttttgctcagatgcagcgatcacaccgacanatcaccagcgatcagaccagaggcaactgc

SEQ ID NO: 58118 - DNA, 101 bp, rice(Oryza sativa)
  misc_feature (71): n=t or c
tttggacaacccaatatcagcctggcaccaatgggtattgccctgatactgataggtaccatatgtgttantaacaggtatcaaacaatacggttgggtac

SEQ ID NO: 58119 - DNA, 101 bp, rice(Oryza sativa)
  misc_feature (71): n=t or g
caaggttaattttaggatattatggctttccagtaaaaattttgaattattttgaagattagctgtacgtntaacacggaattgcagacgaatttattgta

SEQ ID NO: 58120 - DNA, 101 bp, rice(Oryza sativa)
  misc_feature (71): n=t or g
cattgtctctttttatggctgcgaactatgggaaatgattcatatcaatacatttggagcggaatacaagnccaaataatatatgtataacatatgcacga

SEQ ID NO: 58121 - DNA, 101 bp, rice(Oryza sativa)
  misc_feature (71): n=a or g
gacatatccaagctcaactcttctttacagccttagaggcagctctttcagtttcagtacccggaccactntcaataatgcaatgaagtaatcgacatcac

SEQ ID NO: 58122 - DNA, 101 bp, rice(Oryza sativa)
  misc_feature (71): n=t or g
gaagaaattgaaataggcccatctacataagtgaggcctaatgggcttctaggatgaaattagcccatcangtattacgtgtgggccgtagcccgtagccc

SEQ ID NO: 58123 - DNA, 101 bp, rice(Oryza sativa)
  misc_feature (71): n=a or c
tttagaaatcaaattaagcttagataatttatgttatgggactgccatatctcttaaaatttctccgtttnagtaattcaagaataatctacaccgaagat

SEQ ID NO: 58124 - DNA, 101 bp, rice(Oryza sativa)
  misc_feature (71): n=a or g
taattcttgttctgtagatgtcagaaatgacatatttttctgtgttatgtgatgtagaattggaggtatcnaattgttaatctatgctgcttttataggaa

SEQ ID NO: 58125 - DNA, 101 bp, rice(Oryza sativa)
  misc_feature (71): n=t or c
tgaccggtggctgcggccatgaacatttcccctctcaagatcctgttggatggacaatgttcaagaaatantttcttcaagccatattcagttaatcctta

SEQ ID NO: 58126 - DNA, 101 bp, rice(Oryza sativa)
  misc_feature (71): n=a or c
tgtctggcatagttcaaatagagatgaattattgatgcagggtagctcctggctatggtggacctagaaanattcacctgtaggatctgttataatttatt

SEQ ID NO: 58127 - DNA, 101 bp, rice(Oryza sativa)
  misc_feature (71): n=t or c
tagctcatttttccctgttagaggtttatgctcagtcttaatgtgagtccactaaaatcttggctggtttntactttgtttactaataaccaagagaaaca

SEQ ID NO: 58128 - DNA, 101 bp, rice(Oryza sativa)
  misc_feature (71): n=t or g
tgacaaaaaaaataaccaggttgattggcttattgggctcatttgccaagcatttacagtggctaaaattntactagttcttttttgggtaaaatcatgtt

SEQ ID NO: 58129 - DNA, 101 bp, rice(Oryza sativa)
  misc_feature (71): n=t or c
cattgaaccaggcacacatgaagtggttcgtcactggggccagctccctcacaatgactgaagcttcaganaaagctgaaaaatataacagatatattgat

SEQ ID NO: 58130 - DNA, 101 bp, rice(Oryza sativa)
  misc_feature (71): n=t or c
tcgacgatcaggttcctatggggctatggggcatgggctacgtcactagaaactccgatgactgcacatangagggaaactgttttaacggctcgagtgga

SEQ ID NO: 58131 - DNA, 101 bp, rice(Oryza sativa)
  misc_feature (71): n=t or c
tctatgcacatactctctgctcctgacactaaatgtcgatttcttgtaggattcagagatgacggcgagangcaaatttgtcaggcaatgtgattaagtag

SEQ ID NO: 58132 - DNA, 101 bp, rice(Oryza sativa)
  misc_feature (71): n=t or c
cggagccagctctagattaatcgggccgatcgattcgtcactgtcatacatttgacaaatgctaaagcaanagttcgatcgatcggtcttttcttaattag

SEQ ID NO: 58133 - DNA, 101 bp, rice(Oryza sativa)
  misc_feature (71): n=t or c
tgacgacattggtcttatagatccggatgtactaacatgtaccgttaattaattatttactctctccgtcnaaaaaaaaaaagataaaccctaactttccg

SEQ ID NO: 58134 - DNA, 101 bp, rice(Oryza sativa)
  misc_feature (71): n=a or g
gaggggtgtggaggaaagaaagaagtatgaggaataagaaagggcggacgtcgcgtggacttagctccctncactcaccgtcgcgtggacttagccccctg

SEQ ID NO: 58135 - DNA, 101 bp, rice(Oryza sativa)
  misc_feature (71): n=t or g
acatgcatagtagtagtcccgaaccacattttcgttgatctcatagttagtctgttcatgggttcaatttnttatccttcgatctacgattgcgtattgct

SEQ ID NO: 58136 - DNA, 101 bp, rice(Oryza sativa)
  misc_feature (71): n=t or c
tgtcactagataatcctttgcctgaaataagtagatctgtttcttgttcgtgctggggagccggagcacangcctagtgtttttgtgcactcgtcgttgcc

SEQ ID NO: 58137 - DNA, 101 bp, rice(Oryza sativa)
  misc_feature (71): n=a or g
aactggggcgaaccatccgatacccccgttcaaaaacgcgacaccacatggagctccggcggcgagcgtcntcgtcgacgacgatccgacgctgctcacgt

SEQ ID NO: 58138 - DNA, 101 bp, rice(Oryza sativa)
  misc_feature (71): n=t or c
cttcttctcttgttacacattttagcaaaggggtagtgactccactcttgtacaactgcccttctatcacnttgtattttcttgacattaactgtattctt

SEQ ID NO: 58139 - DNA, 101 bp, rice(Oryza sativa)
  misc_feature (71): n=t or c
aaccaacacaccgtttacttagaaatgccaagatctggtcatacattggatccagtggtcaccgtcccagnttgctatggcaacaagcctaccgtccttgc

SEQ ID NO: 58140 - DNA, 101 bp, rice(Oryza sativa)
  misc_feature (71): n=a or c
ctgcggcccaagaatggggaagtgattagcccatactaattgggccatgatgggattctgactaattgggnctgaacaggatttcgatttctcacggccca

SEQ ID NO: 58141 - DNA, 101 bp, rice(Oryza sativa)
  misc_feature (71): n=t or c
acctaacaagtctagctagctttccctctataatgtgcttttcttatctttctcctcaagctagcacttanagaaacaatataaactagactttaaaacac

SEQ ID NO: 58142 - DNA, 101 bp, rice(Oryza sativa)
  misc_feature (71): n=a or g
tttggtgccttgtgaattttcgatgagtattgtgatgggtggaccctggacagttgttctgccgggcggcnaggcttaccgcgcgttgcttgctccaggag

SEQ ID NO: 58143 - DNA, 101 bp, rice(Oryza sativa)
  misc_feature (71): n=a or g
gtcctccaagatgcgccattcctctggcaagcgcgctcgtctctctcaggagtgtggtgtgtaggagactnaagacgatgggggcaatgttggaagcggca

SEQ ID NO: 58144 - DNA, 101 bp, rice(Oryza sativa)
  misc_feature (71): n=a or g
aaacttattttctcaggcggagctcttcgcatgggaaaatatttttttgcaggtggcctcttaaaaatccntcttaaagtctgacttacctcctctttcac

SEQ ID NO: 58145 - DNA, 101 bp, rice(Oryza sativa)
  misc_feature (71): n=t or g
aagactacccaccatccagtccacaaataacagagagatctatacgatttttcattactctaacaacgatnatcatccctcgataggagtattaatcttat

SEQ ID NO: 58146 - DNA, 101 bp, rice(Oryza sativa)
  misc_feature (71): n=a or g
aggacttaaaaaaagtaaattacatactgggacacttttttttacgaccctttcaatttgggtcacggatntatctacatttctacattttaccatataaa

SEQ ID NO: 58147 - DNA, 101 bp, rice(Oryza sativa)
  misc_feature (71): n=t or c
cacacatgcctaatcttaattgggtcaggatgtcacaccaaccataccattttttttttggcaaagttgcnaaaggtgtgcatacatttagtttttttttt

SEQ ID NO: 58148 - DNA, 101 bp, rice(Oryza sativa)
  misc_feature (71): n=t or c
agcacacgttcaccacgtggaatctacctagaggaaaggaaagggagtagtcacttaaaatatcccgtagnaatagatcccgttgtgtagctgccctctat

SEQ ID NO: 58149 - DNA, 101 bp, rice(Oryza sativa)
  misc_feature (71): n=t or c
gagcaaagttaacctgcttcgcacatctattaatttgttcaaagttatatatcctctatgttgttaatatngttgttagacttctaaaatttgttgctaaa

SEQ ID NO: 58150 - DNA, 101 bp, rice(Oryza sativa)
  misc_feature (71): n=a or g
tggtttgcaagtatagtgggggtcctatttgtcaggataactttgtccaaaatcaaacactttaacctttntaatatttttttcataaatttatatagttt

SEQ ID NO: 58151 - DNA, 101 bp, rice(Oryza sativa)
  misc_feature (71): n=a or g
ttttttaccggatacgaaaatgaatacggatagctcaagtatgaaaacaaataaggattgtctcaaaaacnaataaaaatcgaatatgatcggatacgaat

SEQ ID NO: 58152 - DNA, 101 bp, rice(Oryza sativa)
  misc_feature (71): n=a or g
tggtttttctggaagacattaatcacgtggcatcgtttatacatgatagaatcggatataaattgttttcnttgcagcgttgtgattgattcattaactaa

SEQ ID NO: 58153 - DNA, 101 bp, rice(Oryza sativa)
  misc_feature (71): n=a or g
agaagagatgactgacttgacactcttctttgcaatgacatggaatataccattataatgttgtacactanggatgggaggcatcggagaagcaagtggca

SEQ ID NO: 58154 - DNA, 101 bp, rice(Oryza sativa)
  misc_feature (71): n=t or c
tttcgatagataagatcacttcaagaatcatacaaggatattagcctcaatctctcatatctatcaatagngaataatgtgcctcgttggtgtcggtgagg

SEQ ID NO: 58155 - DNA, 101 bp, rice(Oryza sativa)
  misc_feature (71): n=a or g
cagacatcgtacaatcttttgtagcttacaactgattcttgagtgccgatcgatattccaattgcattttncactgtggtctgtgggcacaagtttaagaa

SEQ ID NO: 58156 - DNA, 101 bp, rice(Oryza sativa)
  misc_feature (71): n=a or c
aggagttgtacacaatcagaacgggagaaatgatactaacttaatcacatcatctttgtttcagacattgntctagggacaagcttccaatcatcaatagc

SEQ ID NO: 58157 - DNA, 101 bp, rice(Oryza sativa)
  misc_feature (71): n=a or g
aattgctgctgctttttatttagcatttggaggagattagagccagaggttaagactacaaactgatcacnggttatactacaatacaaactgcctatcta

SEQ ID NO: 58158 - DNA, 101 bp, rice(Oryza sativa)
  misc_feature (71): n=a or g
caccttgaagctgagagtgtgcgccaacgtgctaaacgggctggtcgatgcgaagatcggacatggcaccnacgattgctgctcgctgctatctgggatcg

SEQ ID NO: 58159 - DNA, 101 bp, rice(Oryza sativa)
  misc_feature (71): n=a or c
acagggcaataaaagaggtacaaccgactcgtactttgcataaaaacaagacctggaaagtactaaaaaancaatcaactttacaatagaaaccgaacaaa

SEQ ID NO: 58160 - DNA, 101 bp, rice(Oryza sativa)
  misc_feature (71): n=a or g
tttctaaaaaaaaacaattcttccggtttttttaaatgttcatctaaaacggtaactaagtgctccctccntcccagaatataaagagttttaaagttgaa

SEQ ID NO: 58161 - DNA, 101 bp, rice(Oryza sativa)
  misc_feature (71): n=t or g
taccgaatcaaagtattcgggacctgttgcggagggcttttatgtaattttctccccttttttcttctatntcctcactggccttttcctcttcctctttc

SEQ ID NO: 58162 - DNA, 101 bp, rice(Oryza sativa)
  misc_feature (71): n=a or g
tgccatcggggactactactacacccgtctaaaattaggatatctttttgagtttttacttataacatttnactattcttcttatttaaaatattagtgta

SEQ ID NO: 58163 - DNA, 101 bp, rice(Oryza sativa)
  misc_feature (71): n=a or g
gtaattttcaggaatctgcagtaatttcaaagcaaacagttttgttctcacagaaaccgaaaaaaacctgnatttctagctaatggatgatggatgaaact

SEQ ID NO: 58164 - DNA, 101 bp, rice(Oryza sativa)
  misc_feature (71): n=t or c
tatatatgaataactaatacaaataagtgagggggcggggggatgaaatcaatattctcaaagatatatgntgtcctagagagtggtagaaaccctgaaaa

SEQ ID NO: 58165 - DNA, 101 bp, rice(Oryza sativa)
  misc_feature (71): n=a or g
acaaaatatatagacttggtaaaagaatacatcccctcttgtatataaacctgctcgcgggggatgggggnaggatggggcgttgtcgtggcggacagatt

SEQ ID NO: 58166 - DNA, 101 bp, rice(Oryza sativa)
  misc_feature (71): n=t or c
cttgatggaccgtgtcaggcttgccactccgtgccgccgcaatgtctcaggaccacacaaatgttgtttgncggtagctcgacgaaccacgccaaggttgc

SEQ ID NO: 58167 - DNA, 101 bp, rice(Oryza sativa)
  misc_feature (71): n=a or g
tctaatagtgtgttctctctctagaggtacccgtgcataaattcaagccggaccgctatacattttactcnaaacaaaatcagaactaaaaaaacatcctg

SEQ ID NO: 58168 - DNA, 101 bp, rice(Oryza sativa)
  misc_feature (71): n=t or c
cgccgtgcatggaattgggatcgacgtctcatcgtctcgtctcttaaatcggcgccacgtggaattagatngctcagcaactaacaacaggacaaaatcaa

SEQ ID NO: 58169 - DNA, 101 bp, rice(Oryza sativa)
  misc_feature (71): n=a or g
cacaagggaattgaggaaccgaattagtaactccctccgttccgtaataaacggagccatgtatgtttctntgtccaactttaataggccgccttatttaa

SEQ ID NO: 58170 - DNA, 101 bp, rice(Oryza sativa)
  misc_feature (71): n=a or g
agaattcataatctgttttacgcttagacgagataatgcatatggagttctggcgccacgatcagggtagnccgtaggcggaacgacgaacgggcgatcaa

SEQ ID NO: 58171 - DNA, 101 bp, rice(Oryza sativa)
  misc_feature (71): n=a or g
ctcttccctcaaattctccccactgctaccaccgacagcattccttggaaccacccgtgctccaaccccancgccgctacagccaatgccacttcccagcg

SEQ ID NO: 58172 - DNA, 101 bp, rice(Oryza sativa)
  misc_feature (71): n=t or g
ataaaagaaaatttatagaaaaagacaaatggtcaaagttcaatataaatagtgtttgaacaagtatctgngaaggagagtactccctctgtcccaaaaaa

SEQ ID NO: 58173 - DNA, 101 bp, rice(Oryza sativa)
  misc_feature (71): n=a or g
taagtgaattaagattagttaatccaccaatctctagtggtatgtgtccagtgatttgattctaggacatntctaagccttccgaaagtgtagaaatggaa

SEQ ID NO: 58174 - DNA, 101 bp, rice(Oryza sativa)
  misc_feature (71): n=a or c
gaggacacgggccgacgagcaggagcatatgcgccgtgaatacatatgacgattagtctggcagactggcnctagtagactccagtaacacggggaggaga

SEQ ID NO: 58175 - DNA, 101 bp, rice(Oryza sativa)
  misc_feature (71): n=a or g
acaaatcaattcatcacaagaacaaaggttggagaagggtgtcgacaggaggatcacactgccgatggganggcgtgccatggccaccgtgcgccgtgagg

SEQ ID NO: 58176 - DNA, 101 bp, rice(Oryza sativa)
  misc_feature (71): n=a or g
caagtccccgccaccaacgtctcccagatctgacagcgaaaacaaagaggccgagagggagagggagacgnagatggtgagggaaggttgtctccaaacca

SEQ ID NO: 58177 - DNA, 101 bp, rice(Oryza sativa)
  misc_feature (71): n=t or c
aacgtttgctacgctcaaatcggtgaccgcttaaatttttggacgagtttgactcagggcctgtttggttncagggacttatttcaagtccctgtcacatc

SEQ ID NO: 58178 - DNA, 101 bp, rice(Oryza sativa)
  misc_feature (71): n=t or c
cactagtgttgagatgtggcaccaccggtgttatgttcaacaagttcaagtctggctgtggtgggtgcggngtagcctggttaagtaggtcaaggaacatc

SEQ ID NO: 58179 - DNA, 101 bp, rice(Oryza sativa)
  misc_feature (71): n=t or g
aagcatcaacattgagacaacgcaataatattgcaactggcagttttaacaaaaggaacggtaacagaagnatgttataccctgtgaaagttccttcgcta

SEQ ID NO: 58180 - DNA, 101 bp, rice(Oryza sativa)
  misc_feature (71): n=a or g
gattctaactccgcgaccaactctgcaccggcgcccccaaccataaataaccacctcctcctccccttccncctcgctcccgcctcccgcgcccgcgcatt

SEQ ID NO: 58181 - DNA, 101 bp, rice(Oryza sativa)
  misc_feature (71): n=t or c
aagaagaagaagaaatctactactagtccagttgcagttgcagaggcatattgtggttggataatggaganggtgtcggtgtgcgggctccacccgggcgt

SEQ ID NO: 58182 - DNA, 101 bp, rice(Oryza sativa)
  misc_feature (71): n=a or g
atatttgttggcttgtctccaaggagactactaacttcatgcaaagccaactataaatcatcaacttaccnaatccaaactgtgagcataaaaagtgctta

SEQ ID NO: 58183 - DNA, 101 bp, rice(Oryza sativa)
  misc_feature (71): n=t or g
ttcagaaatctagatgatttttttcctaaaacaatgggatatgttctttccaccataatagaatggaatangatctgtttggcacagctccagctccagct

SEQ ID NO: 58184 - DNA, 101 bp, rice(Oryza sativa)
  misc_feature (71): n=t or c
ataattcaaatcggttttgctatgtttttaccgtaccaacgttgcacaaaacttcccagctgctagctatngagaggggattacacgggacagagaatcaa

SEQ ID NO: 58185 - DNA, 101 bp, rice(Oryza sativa)
  misc_feature (71): n=a or g
acgaacctcgccgacgactggtgatggcggtgcatggcgacgaagcacacgatgacaaggctgcgcgatcntggatgaccgatgccggcggcggtgacgac

SEQ ID NO: 58186 - DNA, 101 bp, rice(Oryza sativa)
  misc_feature (71): n=a or g
ttcgattcatactcagtcaactagatacatgtaacagtagagtcttccatactaattaagtactacctctnttttttaataaatgacgccgttaacttttt

SEQ ID NO: 58187 - DNA, 101 bp, rice(Oryza sativa)
  misc_feature (71): n=t or c
taaggtttctaaacataaaaatgaaataataaaacatcttcctagactaagtgaagatatctcccccatcnaattaatatcctcgcaatactacatgcgca

SEQ ID NO: 58188 - DNA, 101 bp, rice(Oryza sativa)
  misc_feature (71): n=t or c
tctctctctctctctctctctcccgtgtccgcaaccgcaaatccccatttggtctcacctaaaaccctagntcgctcacccatggctccgaagaagcgaaa

SEQ ID NO: 58189 - DNA, 101 bp, rice(Oryza sativa)
  misc_feature (71): n=a or g
gcaaaggaggccaggcgaccagggtttaagttaagggcttatcgtgggggtacggaaatataaataccacngtaattttcttaaatttaaataaatttaaa

SEQ ID NO: 58190 - DNA, 101 bp, rice(Oryza sativa)
  misc_feature (71): n=t or c
ctgacccattcattttttgtattgtgcagccaacacaaacagtaagttgagtctacagttgcagcagcaanggctgcatacagtggctgtaccagccagcc

SEQ ID NO: 58191 - DNA, 101 bp, rice(Oryza sativa)
  misc_feature (71): n=a or c
gcggagggaatgagttcccaacacagaatcgaacgcagcctaagaacactgaagagccagccgtcaaatgntattgttaatatgagtatatataatacttt

SEQ ID NO: 58192 - DNA, 101 bp, rice(Oryza sativa)
  misc_feature (71): n=t or c
ttttattggttcaattaatggttttgcgtaaacagctattttcgatcagcggacggtttttcgaccttctnatttttggccttcctactattcttgctatg

SEQ ID NO: 58193 - DNA, 101 bp, rice(Oryza sativa)
  misc_feature (71): n=a or g
ttgtctttttagttgacatagatccaatctacatcaccagacgtagggtattaccccatgctaagggcctnaaccaggataatcgtctatgtcaccatctc

SEQ ID NO: 58194 - DNA, 101 bp, rice(Oryza sativa)
  misc_feature (71): n=a or g
caaacaacacacgatctaaaagctaacgaaactactattccgggaaagattggattttaggtcagctccgngagaaacttcacttgaccttcgcagaacga

SEQ ID NO: 58195 - DNA, 101 bp, rice(Oryza sativa)
  misc_feature (71): n=a or c
tgccttcctgtgagctggctcccgtgcaacatttggcctttttttttcttctttgttgcaattgatctagncttcggaccagcacacgggcatgtgttgta

SEQ ID NO: 58196 - DNA, 101 bp, rice(Oryza sativa)
  misc_feature (71): n=a or c
aagttcgaccaatgcaaatttggatcactatttcaattggaattgggaatttctggcagcctatcaagacngcccgcaaaatgggttgtgcagtggatggg

SEQ ID NO: 58197 - DNA, 101 bp, rice(Oryza sativa)
  misc_feature (71): n=a or g
tcttcgcctagcttctctcttaactaatcacaacattcttttaattatttttacctactttcgtaataccntgtccaacttaaaaatgcttatattttggt

SEQ ID NO: 58198 - DNA, 101 bp, rice(Oryza sativa)
  misc_feature (71): n=a or g
ttattaatgaattattactactcagtcaccttgtattggtgcactgacaatgtataactgaatatccactntaagtttagttaactgttctgcatattaca

SEQ ID NO: 58199 - DNA, 101 bp, rice(Oryza sativa)
  misc_feature (71): n=t or c
atcttcctaaccaccaccctataccaactctactgtaccatcttctgaggtacaaatgatgcatatgctanatgccctctctccaatggataacgacagag

SEQ ID NO: 58200 - DNA, 101 bp, rice(Oryza sativa)
  misc_feature (71): n=t or g
tttactcaaaaccgtacgcttttcaatgttaacaccgaatttatagtggtttagatgatgtgaagatgacntacttaaaaaacaaatctagaactagatgt

SEQ ID NO: 58201 - DNA, 101 bp, rice(Oryza sativa)
  misc_feature (71): n=a or g
tattatagtgtcttgtttgtgctgatccatctctttgcgtgtcaatcatgcgatcccttctctgttttgcntgggtgtgctggcgagttctattactgtta

SEQ ID NO: 58202 - DNA, 101 bp, rice(Oryza sativa)
  misc_feature (71): n=t or c
caaattcatcaatcgatgagcacaattatacacaaatgcaatgctgattctaatattctatccatggtttngattggacttacacaaatgcaatgctgatt

SEQ ID NO: 58203 - DNA, 101 bp, rice(Oryza sativa)
  misc_feature (71): n=t or c
gagcagcttgagcagctggaggcggatgtccacctgccggtactccaccgtgcagctctccatctccaggntctccagctgcgggcaccacttgcccgggg

SEQ ID NO: 58204 - DNA, 101 bp, rice(Oryza sativa)
  misc_feature (71): n=t or c
cctcccttccatcatgtaagtgcgtacttagtatatacatgtatatatcggtccctctacctattcggttncctctctctatgatgtattattagccatca

SEQ ID NO: 58205 - DNA, 101 bp, rice(Oryza sativa)
  misc_feature (71): n=t or g
gacacagtacggtagcacatgatctacacgacctcattttacaggtacatgctgattgatcaaaatacaantaacccagaaaaaatgatacgcacacaaac

SEQ ID NO: 58206 - DNA, 101 bp, rice(Oryza sativa)
  misc_feature (71): n=t or c
gctccgtttcaaaataaaaagatttctaggttattaagcagaggttaatattaagataggggcaaacatanatcatgtgtcacatatgccacagcccgagg

SEQ ID NO: 58207 - DNA, 101 bp, rice(Oryza sativa)
  misc_feature (71): n=a or g
gatcttatgaaggtcgagggaggacggtgatgatggcgtgccatgacgtcgagatgttgttcctgcgggcnatcgatgtgaaccggctggcgccagcggtg

SEQ ID NO: 58208 - DNA, 101 bp, rice(Oryza sativa)
  misc_feature (71): n=a or c
ttctgctatgtttggtgtcctatagtttaatctggtgacctcatcttagacaagataggatagtgagtggngattctctttgctttctttgattaatgtgc

SEQ ID NO: 58209 - DNA, 101 bp, rice(Oryza sativa)
  misc_feature (71): n=a or g
cctcccatggtgagccggcatggagagttggaggtcgaggtttgtcaaggcgaggatgggtcctttcgacnacgacgcaaggagaaccaattggtgctaag

SEQ ID NO: 58210 - DNA, 101 bp, rice(Oryza sativa)
  misc_feature (71): n=a or g
gcatccaggatgtacacaagcaaagttactcttttaacatgcaacttagcagtggtactagaagatattgntcaaatacattattatactttgttaatgat

SEQ ID NO: 58211 - DNA, 101 bp, rice(Oryza sativa)
  misc_feature (71): n=a or g
ttagtattatatatacaatcgcactaaatctaaacagggatgattaaaaggactaaaatgagaaaattagngttatacaatcgcattaaatctaaacaggg

SEQ ID NO: 58212 - DNA, 101 bp, rice(Oryza sativa)
  misc_feature (71): n=a or g
tgtggtttaggagtgaaagcaaatagagtatacaatagaccaaacttttccaagtcactttcattttatgncttgttgagctgatgttcaatagtcagcat

SEQ ID NO: 58213 - DNA, 101 bp, rice(Oryza sativa)
  misc_feature (71): n=a or g
tggtgtataaacccggactaattaggactataataaaccaatggatagtaggggtagcgtgtataatttancagtaaaaacaatcttttataaaatactac

SEQ ID NO: 58214 - DNA, 101 bp, rice(Oryza sativa)
  misc_feature (71): n=t or c
ttctcagtaggatgtgcctagcttagcagaacttccagtgattgttgcagttcacgcaggtcacgaacgtngtcatcggctcgtcggcgctccgagtctgg

SEQ ID NO: 58215 - DNA, 101 bp, rice(Oryza sativa)
  misc_feature (71): n=t or c
ttatttgttagcgttacaggatagatcaagcaattcttagtctaggaccattaacctgagtattggatttnataagttgagaagaacgtatgcatatatat

SEQ ID NO: 58216 - DNA, 101 bp, rice(Oryza sativa)
  misc_feature (71): n=t or c
ccacatgtgctaggaatgggatggccttagcttattaagttgtttaatgtctgaccttgcattgggaggcngtagtagtatgaactagtcggaatgatggt

SEQ ID NO: 58217 - DNA, 101 bp, rice(Oryza sativa)
  misc_feature (71): n=a or g
gaagcaggaaaggtacaagaccggcagctgctataaatccaaaaacctcaacctgtgagttctcttcccantgtctctctcatcaaaggtacagtagcagc

SEQ ID NO: 58218 - DNA, 101 bp, rice(Oryza sativa)
  misc_feature (71): n=t or g
cactcgcacaagagtgatgcgaaggcttcagttctatctatgcgactcttttttgtcatagtcttttgttntattttctatttctatgttgttgtctactt

SEQ ID NO: 58219 - DNA, 101 bp, rice(Oryza sativa)
  misc_feature (71): n=a or g
ttagggcctttttcagctatgatgcagaagaacaaaacaaaagacagcaataactaattcaggaaacatanaacgaaaaaatagagatgagatgaaatatg

SEQ ID NO: 58220 - DNA, 101 bp, rice(Oryza sativa)
  misc_feature (71): n=t or c
aaacatctaactacaaaaagtagagtgccatggcccacgtggtcctataaaagtcagcgagttttcaactncaagatttctttatggaaaacatgtcttat

SEQ ID NO: 58221 - DNA, 101 bp, rice(Oryza sativa)
  misc_feature (71): n=t or g
tcagttgttatgactaccattttgttagggctgaaatgagaaccctcttttcatgattctagcatataatnagtatatttgaccaatcttaggtttccaag

SEQ ID NO: 58222 - DNA, 101 bp, rice(Oryza sativa)
  misc_feature (71): n=a or g
gtgcgattggttagggagggttatgcgaaatgttctgtcacagtttctttctagtatatcgtggttgcatnttggcgcacgacaacgtgttctgagattgt

SEQ ID NO: 58223 - DNA, 101 bp, rice(Oryza sativa)
  misc_feature (71): n=t or c
agacaatatatagacaaatgctagtggccgactaaccaaatgtgtgctttgacagcacaaatcaactcttnagtgttttgccatgattgttatatgcctga

SEQ ID NO: 58224 - DNA, 101 bp, rice(Oryza sativa)
  misc_feature (71): n=t or c
aaattaattaatctgctgctggtgagggttttctcatgcatgacgtacgtaagttagcagctactggaaanactaatcgggactaaaaataaaaaatcttt

SEQ ID NO: 58225 - DNA, 101 bp, rice(Oryza sativa)
  misc_feature (71): n=a or g
agagagagaggccatggaattgcaagaagccgcggccgtccacgatgaacctgtgacggcgtcgatgggtngagaggtacgtatatactcccctccgtttc

SEQ ID NO: 58226 - DNA, 101 bp, rice(Oryza sativa)
  misc_feature (71): n=a or g
gtgcacgcagagatgttaaacgttgttctgcactttgctgtaactgtacgcacttcctccgttttataatntaagttattttagcatttctcatattcata

SEQ ID NO: 58227 - DNA, 101 bp, rice(Oryza sativa)
  misc_feature (71): n=a or g
gactgctgcctactatatcttcgggtatcaggcaggtatgctcacaggcaaaatattacacacgttcgccngcggcggcgaggcctccaggctaggcggcg

SEQ ID NO: 58228 - DNA, 101 bp, rice(Oryza sativa)
  misc_feature (71): n=t or c
acaatgttcatccatttccacatcacacggaatctggttgggatcgttgtatggcattttcaggttccacncagtctcccattagggttaaataaaggata

SEQ ID NO: 58229 - DNA, 101 bp, rice(Oryza sativa)
  misc_feature (71): n=t or c
cttcatccctatttctttctcctccactcttctttccctcctccatcatctcttcacctacatctcccccnggtatggcattcatctcctcacataagtgg

SEQ ID NO: 58230 - DNA, 101 bp, rice(Oryza sativa)
  misc_feature (71): n=a or g
gcctctgagtgtgccatcggcatcaacctagagtgcacatcaccgctggaggaaaccatctatactctacntgcttcccacagcagcctaattcgagttca

SEQ ID NO: 58231 - DNA, 101 bp, rice(Oryza sativa)
  misc_feature (71): n=t or c
ctctcggcaattgaaagtcaaaactgttgagataattatataactgtgactatgcagttacttatacaaanattttcggtaattggcttagaggggtatct

SEQ ID NO: 58232 - DNA, 101 bp, rice(Oryza sativa)
  misc_feature (71): n=a or g
gcttggatttgttaattttggttttaaaaccttgagtgaaagaataacttatactccctccttactcgtanaagttgttttggacagcgacacggtctcca

SEQ ID NO: 58233 - DNA, 101 bp, rice(Oryza sativa)
  misc_feature (71): n=a or g
atattgcataaaaatatgaataagaaataagagagagaacagagaaaagagaaagagagaggggaggcgtnggggctgtccacacagataagtacgtacgt

SEQ ID NO: 58234 - DNA, 101 bp, rice(Oryza sativa)
  misc_feature (71): n=a or c
tgccgtcatccatggctgtggatccccttgtgtctgccgtcgaggtgagcccctgccgctgtgtcgatttntatgatcggcaatatatttcacgggtgcgc

SEQ ID NO: 58235 - DNA, 101 bp, rice(Oryza sativa)
  misc_feature (71): n=t or g
catttattcacctctagattattagtggcatcttcttagtatctctaataatcttcttccaccttataaanatagcaatattatatcgtatatttatgact

SEQ ID NO: 58236 - DNA, 101 bp, rice(Oryza sativa)
  misc_feature (71): n=a or c
atcggttggaacaacttgtcttcttctcaactcaaacaagtgttttacgctaatcataactacataaaaanattgtatttcgtgacaagcatgtgaacgag

SEQ ID NO: 58237 - DNA, 101 bp, rice(Oryza sativa)
  misc_feature (71): n=t or c
gtcttgtatttctatcgtcctagttcagtgtagtttatgtagttagttcatgcatattattgtaccccttnttttagttgtgtacactatgcaaaagttac

SEQ ID NO: 58238 - DNA, 101 bp, rice(Oryza sativa)
  misc_feature (71): n=a or c
gtattggcaaactttaacttaatggattaattacagagatttctagttgcatacgaggaaggtggaaaaanatgtcgagacagagcaaagaagagaaggaa

SEQ ID NO: 58239 - DNA, 101 bp, rice(Oryza sativa)
  misc_feature (71): n=a or g
gatctatacacccatcagtcctcatcacacatgcaaaactgttggagaaataaacatcttatgtgaatgtntctttattaaagagtttatgatcaaaccca

SEQ ID NO: 58240 - DNA, 101 bp, rice(Oryza sativa)
  misc_feature (71): n=a or g
ccctccgtgcagacatgtcaccatcgccatggaagcccacactaccaagctgcgagagcccagtgctacancattgggctgcttgagtatcccctgcacgg

SEQ ID NO: 58241 - DNA, 101 bp, rice(Oryza sativa)
  misc_feature (71): n=t or c
ttttattttacaatttttcccttgcttctcaggttggcctctgcacgctgcatgtgaacagttcggtaaanataagtggtcacagcgtcgagtttaaccag

SEQ ID NO: 58242 - DNA, 101 bp, rice(Oryza sativa)
  misc_feature (71): n=t or g
gacggagactatgaccgcctgaaaaaaaaaattctagtaatgaatggactttttgcatggggtgaactgancttgaataagaaaggtcaattgaagatgat

SEQ ID NO: 58243 - DNA, 101 bp, rice(Oryza sativa)
  misc_feature (71): n=a or c
ggagagagagatcgatcgaacgaggcgtcgccgtcgatcgccgtcgtgccggatcgtttggttagcttgcnagacatgcttatatactccttccgttacat

SEQ ID NO: 58244 - DNA, 101 bp, rice(Oryza sativa)
  misc_feature (71): n=t or c
gggtgctggtgcagacctcgatctacacaaaggaagaggtgaatgccatcctgatccagtgcggccggctnagccggagctcgtcatcgtcggggatgcgc

SEQ ID NO: 58245 - DNA, 101 bp, rice(Oryza sativa)
  misc_feature (71): n=a or g
tttaaagatgagaattcaaaagatatcacttgcacttacatttcctagttcaaagtaggtggtaggtcctntacctgtatttggttgttaccacatgttat

SEQ ID NO: 58246 - DNA, 101 bp, rice(Oryza sativa)
  misc_feature (71): n=a or g
ggcgagaggagtttaggtcacgatgaggcttttatttggcagactcagctcaaggaaagttttgtgggctntgggcatcctagctatttgatcagcaccga

SEQ ID NO: 58247 - DNA, 101 bp, rice(Oryza sativa)
  misc_feature (71): n=a or c
tttgtgattttagatgaattgtggcatttcaatgtgtcactctagttaacggcctcgaatgaccccttacnagtagggatgaaaacggtcggaaacggtcg

SEQ ID NO: 58248 - DNA, 101 bp, rice(Oryza sativa)
  misc_feature (71): n=a or g
catggctatcaccacctgccacctacctcactttccgtggaggcacacccggatccaacaacatttatttngcctatataccatgcttgtgcaagtaaaca

SEQ ID NO: 58249 - DNA, 101 bp, rice(Oryza sativa)
  misc_feature (71): n=t or g
atatgcaagatacaactaccacccaaagagagaaagtgggagctagcacttgagtgcatgtgcatgtacanagagagaagagagagcttgttttcatttag

SEQ ID NO: 58250 - DNA, 101 bp, rice(Oryza sativa)
  misc_feature (71): n=t or c
gagaaattttaatgtggacttgtcaggtgtctctcctccctccttttctcttcttcctccttgcgagttgngacaaaagatagagaggagagggagaaaga

SEQ ID NO: 58251 - DNA, 101 bp, rice(Oryza sativa)
  misc_feature (71): n=a or g
gcggtaacagcaccagcagatctgctcatgctcatggattctccagcacgtagcaaccaaaacactgtttnctatagtcttgcagccttgccaaagcctgg

SEQ ID NO: 58252 - DNA, 101 bp, rice(Oryza sativa)
  misc_feature (71): n=t or c
atcgtgagtattggtggcgcctatagaaaggtgtcggtttattactataatgtcccagcatcataggtgcngatttgtactaataataactggcacctatg

SEQ ID NO: 58253 - DNA, 101 bp, rice(Oryza sativa)
  misc_feature (71): n=t or c
ctgacggacttttcactgtatcttcagcctatagccttttcttcatggcaagagagatttgccctttcagngaacttatttggcacatcaaagctccatcc

SEQ ID NO: 58254 - DNA, 101 bp, rice(Oryza sativa)
  misc_feature (71): n=t or c
ccggcgtcatcttcttcatcttctgccagccgtcgatttcatttagggagagaagagaaggggaaggaggncggcaacagcccctctctgtcggcaaccat

SEQ ID NO: 58255 - DNA, 101 bp, rice(Oryza sativa)
  misc_feature (71): n=t or c
aaatactaattaattttgtggctagtaaattgcttggtattcgcaattgcggcgaagttattatatatttnggtcacaataaaatctagaaaaaaatatgc

SEQ ID NO: 58256 - DNA, 101 bp, rice(Oryza sativa)
  misc_feature (71): n=a or c
gcgtggagaagccatatcatgcagattctaactacacttgcttccataatcacgtctttctttctaatatnatgtagaaatggcgcatttctttctaatat

SEQ ID NO: 58257 - DNA, 101 bp, rice(Oryza sativa)
  misc_feature (71): n=a or g
atctagcacaaataatgcatgattgtgacgccatatatattaattatctagatgattaccttatacttgancaatgaatgtgggaaatgctagaatgactt

SEQ ID NO: 58258 - DNA, 101 bp, rice(Oryza sativa)
  misc_feature (71): n=t or g
gagtgttagagcgcaacattcataggtgtgcatgtgtgcatcatccgtgtaatagaaaaaaatgttcaaanagttttgaacggtaaacaatatcttaacaa

SEQ ID NO: 58259 - DNA, 101 bp, rice(Oryza sativa)
  misc_feature (71): n=a or c
actgtctgtgggaaatttggacacgcgacccacatctataggcagtttagatatcagttcactccgacatngagtctacatgtggctacaaatcagcagtc

SEQ ID NO: 58260 - DNA, 101 bp, rice(Oryza sativa)
  misc_feature (71): n=t or c
tttacttccatagaaaaggttaattaagttttcttttcttttctatcgctgactataattagcacatactncttctgttttaaaataaaccaacttataca

SEQ ID NO: 58261 - DNA, 101 bp, rice(Oryza sativa)
  misc_feature (71): n=a or g
ttggacaatcattgacttgctaactgactaattgtcatggtcctgacacaagctccggtttgatgagagtncatccttggtcttggatagtacttcctttg

SEQ ID NO: 58262 - DNA, 101 bp, rice(Oryza sativa)
  misc_feature (71): n=a or c
agctgacttcctctgtaagctggcttgcgccgtaagctagctttctttgtaagctggcttctagcgtaagntttcttctgtagtaagcttcccactcataa

SEQ ID NO: 58263 - DNA, 101 bp, rice(Oryza sativa)
  misc_feature (71): n=a or g
ttatctgcatgctaaaagataatatcgaattaatcaacagaccggaacatcggtttgtttctctctgatcncatttatagttctacaaagaggctgaatat

SEQ ID NO: 58264 - DNA, 101 bp, rice(Oryza sativa)
  misc_feature (71): n=t or c
ttactaaaagttgccaaacgcacgctaagattaagtacttccccaatgggtagtagtaatattaacaccgngaactaccaatgctgcagttgaacaaacat

SEQ ID NO: 58265 - DNA, 101 bp, rice(Oryza sativa)
  misc_feature (71): n=t or c
ggcgatgcgatcgggagtaaaatttacaaaaccgatgataaccgtgtggttactatgataatactacctcngttttttaaatagataacgctgttgacttt

SEQ ID NO: 58266 - DNA, 101 bp, rice(Oryza sativa)
  misc_feature (71): n=a or g
ttttaagtgttgtcactttggtactcttttattgtaaggaattcgggtctaagtactcttgtatgactttnggctgtatacatccattgtggatgtagagg

SEQ ID NO: 58267 - DNA, 101 bp, rice(Oryza sativa)
  misc_feature (71): n=a or g
ccgacaaggttagcgggcaaaacattgtgcccgtacccataaccaccgggtacaggcatgcccgctagatncctagcggcacccggcgccactgcctaccg

SEQ ID NO: 58268 - DNA, 101 bp, rice(Oryza sativa)
  misc_feature (71): n=a or c
tgactagccactagatatagaggtaagcaaaagcttccaaccagagataaaaacatatggacctaaccacntagctagagcatcagccaattaagtattta

SEQ ID NO: 58269 - DNA, 101 bp, rice(Oryza sativa)
  misc_feature (71): n=a or c
caccagcgaaaacggattttcactggtggttctaaactcaccgccagcgaaaatggcggttctaaacacantatccctcatcagaattttacaagcggatt

SEQ ID NO: 58270 - DNA, 101 bp, rice(Oryza sativa)
  misc_feature (71): n=t or c
taggatagaattaccatcccaaattatttatagtatcaaaggcattcctttaaatgccagctacttcctcngtttcacaatttaagtcattctagcatttc

SEQ ID NO: 58271 - DNA, 101 bp, rice(Oryza sativa)
  misc_feature (71): n=t or c
ctagaggtctccatcaattccatgaatccattccataccatcctatcctacctgcccttcttctcctcctnctcctcctcgtttcttttggacccaaagtg

SEQ ID NO: 58272 - DNA, 101 bp, rice(Oryza sativa)
  misc_feature (71): n=t or g
acaacgagtaaaagctcgggtcgtctttgctcaggctgtaactaacgctgaaaagttttgatatgtcacanacgtatatttaaagtattaaacgtagacta

SEQ ID NO: 58273 - DNA, 101 bp, rice(Oryza sativa)
  misc_feature (71): n=t or c
atttttttttcacggagtgagtattgcttatatacttctacctaatttatataatctgctagtactatacntactctaagagcaggtacaatagtaggcta

SEQ ID NO: 58274 - DNA, 101 bp, rice(Oryza sativa)
  misc_feature (71): n=t or c
tacaaatggaccacctttactcaaaattatagctacaccactaaaacagattctagctacaccactaaaanataagggtattccaaaatcaagaaaagacc

SEQ ID NO: 58275 - DNA, 101 bp, rice(Oryza sativa)
  misc_feature (71): n=t or g
caacctactatatctacctcagcaataccggaccgccatcacgtcagcagcaagtactccctccctctcanaaaaaaaggcaaaccctaaatttttttata

SEQ ID NO: 58276 - DNA, 101 bp, rice(Oryza sativa)
  misc_feature (71): n=a or g
tgagataatcgaagaaatgccatttacaagtatccaagtcacaaaaatgctatcgagagttccaagaaatnccaccgtacaaacgattttgttctaaaaat

SEQ ID NO: 58277 - DNA, 101 bp, rice(Oryza sativa)
  misc_feature (71): n=a or g
ttttttttcctccacaacatgttcttatgcgaaagaagacagagggtgaatggcaataatcatggtacccngccatccacatgcgtgcaaatgaatgaatc

SEQ ID NO: 58278 - DNA, 101 bp, rice(Oryza sativa)
  misc_feature (71): n=a or g
gaatgtgtattaaaatctctgtccaagactagccggagtacgcaaacgacaatttgataaacagatccacntcttacaaaaataataaataattcttacaa

SEQ ID NO: 58279 - DNA, 101 bp, rice(Oryza sativa)
  misc_feature (71): n=a or g
atcatcagcgacgttcacaacaccactattttgagtgcagcggccagcctcacggctcagtgtggaacctnaaaccattaataatgtatccactgtagcga

SEQ ID NO: 58280 - DNA, 101 bp, rice(Oryza sativa)
  misc_feature (71): n=t or c
gtatcagcgattttcgcaattttcgaacaattaaaataaatctggatacgttctcgatacgtccgcatggnaacgatcaatatgctgtctccacttttctc

SEQ ID NO: 58281 - DNA, 101 bp, rice(Oryza sativa)
  misc_feature (71): n=a or c
catatttatatatagtttctactgacagtgctatgtcaaatttctcatcagcgatctgtaatactatcatnaaaaaaaaggttcaaagaagatataacgta

SEQ ID NO: 58282 - DNA, 101 bp, rice(Oryza sativa)
  misc_feature (71): n=a or g
cagtcctatgactgttgcattgtgtggcagtttttacaaagtagtacctacagttttgtttcttctccacngaggtccctggttcgagctgaaacagagct

SEQ ID NO: 58283 - DNA, 101 bp, rice(Oryza sativa)
  misc_feature (71): n=t or c
cggtatgagctggtacttaattttgctgagactatagatggccaaatgggtcgacggacatggcctagccnaggcacgaccaaggcacggccggagattgg

SEQ ID NO: 58284 - DNA, 101 bp, rice(Oryza sativa)
  misc_feature (71): n=t or g
caaattaaagttgatgcgcgtacggcgtaccactggctctggctggaactaaagtaaagttacgtgtaatnaagtagaagattggacaagaacctatgagg

SEQ ID NO: 58285 - DNA, 101 bp, rice(Oryza sativa)
  misc_feature (71): n=t or c
gccctcccacgcacgcgacgcgacgcgtgatcctcccactccgcgtgagacgcgagaaagaaccggagagngctacgcgtcggtcatacggcgcgaacggc

SEQ ID NO: 58286 - DNA, 101 bp, rice(Oryza sativa)
  misc_feature (71): n=a or c
tactaattggcctaaaactatgattttttttcctcaaagtgtcttgtatatcgagttgtaaaactaaatgntggatcttacgtacacaaaagaattgtatg

SEQ ID NO: 58287 - DNA, 101 bp, rice(Oryza sativa)
  misc_feature (71): n=a or c
gattgccccaagctcctctgctcctcttcctcctcgtattcccctttcccgacctccctgcaaacactcgntctctcgaaagtggagggcatggagaccct

SEQ ID NO: 58288 - DNA, 101 bp, rice(Oryza sativa)
  misc_feature (71): n=t or c
taaaactgctaggagatcatcataccacagcatcactccttgtgccatggctggccagtagctagctaggngttgctaatttattaattaaaccccgcacg

SEQ ID NO: 58289 - DNA, 101 bp, rice(Oryza sativa)
  misc_feature (71): n=a or g
tttttgttggaccggagaaaatcttaaattctaatatgtttttgaagttgtattttcttcaaacgtacacncacatatatataagattgataatttgaagt

SEQ ID NO: 58290 - DNA, 101 bp, rice(Oryza sativa)
  misc_feature (71): n=a or g
gatgttgcttatcttttctttgtatgatccagactaattgacattaagtaatattcgtaggtacccatctncatttgtaatggatctaggatggataagta
